US009580713B2

(12) United States Patent
Breaker et al.

(10) Patent No.: US 9,580,713 B2
(45) Date of Patent: Feb. 28, 2017

(54) FLUORIDE-RESPONSIVE RIBOSWITCHES, FLUORIDE TRANSPORTERS, AND METHODS OF USE

(71) Applicant: Yale University, New Haven, CT (US)

(72) Inventors: Ronald Breaker, Guilford, CT (US); Jenny Baker, Churchville, NY (US); Narasimhan Sudarsan, New Haven, CT (US); Zasha Weinberg, New Haven, CT (US); Adam Roth, Guilford, CT (US); Tyler Ames, New Haven, CT (US); James Nelson, New Haven, CT (US)

(73) Assignee: Yale University, New Haven, CT (US)

( * ) Notice: Subject to any disclaimer, the term of this patent is extended or adjusted under 35 U.S.C. 154(b) by 0 days.

(21) Appl. No.: 14/344,006

(22) PCT Filed: Sep. 17, 2012

(86) PCT No.: PCT/US2012/055745
§ 371 (c)(1),
(2) Date: Mar. 10, 2014

(87) PCT Pub. No.: WO2013/040548
PCT Pub. Date: Mar. 21, 2013

(65) Prior Publication Data
US 2015/0023889 A1  Jan. 22, 2015

Related U.S. Application Data

(60) Provisional application No. 61/535,965, filed on Sep. 17, 2011.

(51) Int. Cl.
| | |
|---|---|
| *B01D 15/38* | (2006.01) |
| *C12N 15/115* | (2010.01) |
| *A61K 31/166* | (2006.01) |
| *A61K 31/381* | (2006.01) |
| *A61K 31/4436* | (2006.01) |
| *A61K 31/55* | (2006.01) |
| *A61K 45/06* | (2006.01) |
| *C11D 3/48* | (2006.01) |
| *C12Q 1/18* | (2006.01) |

(52) U.S. Cl.
CPC ............ *C12N 15/115* (2013.01); *A23L 33/13* (2016.08); *A61K 31/166* (2013.01); *A61K 31/381* (2013.01); *A61K 31/4436* (2013.01); *A61K 31/55* (2013.01); *A61K 45/06* (2013.01); *B01D 15/38* (2013.01); *C11D 3/48* (2013.01); *C12Q 1/18* (2013.01); *C12N 2310/16* (2013.01); *C12N 2320/12* (2013.01); *C12N 2320/30* (2013.01)

(58) Field of Classification Search
USPC ........ 424/9.1, 52; 435/6.1, 91.1, 91.31, 455, 435/32, 375; 514/1, 2, 44; 536/23.1, 536/24.5; 210/679; 510/319
See application file for complete search history.

(56) References Cited

PUBLICATIONS

Weinberg et al, Genome Biology, vol. 11: R31, pp. 1-17 (Mar. 15, 2010).*
Hu et al, Genetics, vol. 143, pp. 1521-1532 (1996).*
Accardi and Miller, "Secondary active transport mediated by a prokaryotic homologue of ClC Cl-channels", Nature, 427:803-7 (2004).
Baker, et al., "Widespread genetic switches and toxicity resistance proteins for fluoride", Science, 335(6065):233-35 (2012).
Barrick and Breaker, "The distributions, mechanisms, and structures of metabolite-binding riboswitches", Genome Biol, 8:R239 (2007).
Blount and Breaker, "Riboswitches as antibacterial drug targets", Nature Biotechnol., 24:1558-564 (2007a).
Blount, et al., "Antibacterial lysine analogs that target lysine riboswitches", Nature Chem Biol., 3:44-49 (2007b).
Breaker, "Prospects for riboswitch discovery and analysis", Mol. Cell, 43 (6):867-79 (2011).
Cheah, et al., "Control of alternative RNA splicing and gene expression by eukaryotic riboswitches", Nature, 447:497-501 (2007).
Corbino, et al., "Evidence for a second class of S-adenosylmethionine riboswitches and other regulatory RNA motifs in alpha-proteobacteria", Genome Biol., 6:R70 (2005).
Crewther, "Studies on Aerobacillus polymyxa. VI. Some properties of the hydrogenlyase systems of bacteria", Aust. J. Biol. Sci. 6:205-21 (1953).
Dobbins and Ljung, "A system of qualitative analysis for the anions", J. Chem. Ed. 12, 586 (1935).
Dutzler, et al., "X-ray structure of a ClC chloride channel at 3.0 A reveals the molecular basis of anion selectivity", Nature, 415:287-94 (2002).
Feagin, et al, "Kinetic reactions of calcium, phosphate, and fluoride ions at the enamel surface-solution interface", Calc. Tiss. Res., 10:113-27 (1972).
Finn, et al, "The Pfam protein families database", Nucleic Acids Res., 38:D211-22 (2010).
Hamilton, "Biochemical effects of fluoride on oral bacteria", J. Dent Res., 69:660-7 (1990).
Hu, et al., "Overproduction of three genes leads to camphor resistance and chromosome condensation in *Escherichia coli*", Genetics, 143:1521-32 (1996).
Kanapka and Hamilton, "Fluoride inhibition of enolase activity in vivo and its relationship to the inhibition of glucose-6-P formation in *Streptococcus salivarius*", Arch. Biochem. Biophys., 146:167-74 (1971).
Kesharwani, et al., "Borazine as a sensor for luoride ion: a computational and experimental study", Tetrahedron Lttrs, 52(28):3636-9 (2011).

(Continued)

*Primary Examiner* — Jane Zara
(74) *Attorney, Agent, or Firm* — Pabst Patent Group LLP

(57) ABSTRACT

Disclosed are compounds, compositions, and methods relating to fluoride aptamers, fluoride-responsive riboswitches, fluoride-regulated expression constructs, fluoride transporters, nucleic acids encoding fluoride transporters, expression constructs encoding fluoride transporters, and cells containing or including any combination of these.

30 Claims, 22 Drawing Sheets

(56) References Cited

PUBLICATIONS

Kim, et al.' "Guanine riboswitch variants from Mesoplasma florum selectively recognize 2,,-deoxyguanosine", PNAS, 104, 16092-7 (2007).

Kim, et al "Design and antimicrobial action of purine analogues that bind guanine riboswitches", ACS Chem Biol., 4:915-27 (2009).

Koo, "Strategies to enhance the biological effects of fluoride on dental biofilms", Adv Dent Res., 20:17-21 (2008).

Lebioda, et al., "Fluoride inhibition of yeast enolase: crystal structure of the enolase-Mg(2+)-F(−)-Pi complex at 2.6 A resolution", Proteins, 16:219-25 (1993).

Lee, et al., "Roseoflavin is a natural antibacterial compound that binds to FMN riboswitches and regulates gene expression", RNA Biol., 6:187-194 (2009).

Lee, et al., "An allosteric self-splicing ribozyme triggered by a bacterial second messenger", Science, 329:845-8 (2010).

Lesher, et al., "Bacteriolytic action of fluoride ions", Antimicrob. Agents Chemother., 12:339-45 (1977).

Levine, "The action of fluoride in caries prevention. A review of current concepts", Br. Dent. J., 140:9-14 (1976).

Lim, et al., "Characteristics of ligand recognition by a glmS self-cleaving ribozyme", Angew Chem Int Ed Engl., 45:6689-93 (2006a).

Lim, et al.,. Molecular-recognition characteristics of SAM-binding riboswitches. Angew Chem Int Ed Engl, 45:964-8 (2006b).

Maltz, et al., "Susceptibility of oral bacteria to various fluoride salt", J Dent Res., 61:786-90 (1982).

Mandal and Breaker, "Adenine riboswitches and gene activation by disruption of a transcription terminator", Nature Struct Mol Biol, 11:29-35 (2004a).

Mandal and Breaker, "Gene regulation by riboswitches", Nature Rev Mol Cell Biol., 5:451-63 (2004b).

Mandal, et al., "Riboswitches control fundamental biochemical pathways in Bacillus subtilis and other bacteria", Cell, 113:577-86 (2003).

Mandal, et al. "A glycine-dependent riboswitch that uses cooperative binding to control gene expression", Science, 306:275-9 (2004).

Marchler-Bauer, et al., "CDD: a Conserved Domain Database for the functional annotation of proteins", Nucleic Acids Res., 39:D225-9 (2011).

Marquis, et al., "Fluoride and organic weak acids as modulators of microbial physiology", FEMS Microbiol Rev., 26(5):493-510 (2003).

Marquis, "Antimicrobial actions of fluoride for oral bacteria", Can. J. Microbial. 41:955-64 (1995).

Matulef and Maduke, "The CLC 'chloride channel' family: revelations from prokaryotes", Mol. Membr. Biol., 24:342-50 (2007).

Meyer, et al., "Confirmation of a second natural preQ1 aptamer class in Streptococcaceae bacteria", RNA, 14:685-95 (2008).

Montange and Batey, "Riboswitches: emerging themes in RNA structure and function", Annu. Rev. Biophys. 37:117-33 (2008).

Nahvi, et al., "Genetic control by a metabolite binding mRNA", Chem Biol., 9:1043-9 (2002).

Qin, et al., "Fluoride inhibition of enolase: crystal structure and thermodynamics", Biochemistry, 45:793-800 (2006).

Rapp, et al., "Identification and evolution of dual-topology membrane proteins", Nat. Struct. Mol. Biol., 13:112-6 (2006).

Regulski and Breaker, "In-line probing analysis of riboswitches", Methods Mol. Biol. 419:53-67 (2008).

Ren, et al., "Fluoride ion encapsulation by Mg2+ ions and phosphates in a fluoride riboswitch", Nature, 85-90 (2012).

Reus, et al. "P.2.d.001 antidepressant properties of ketamine plus imipramine treatment behavioural and molecular studies in rats", Eu Neuropsychopharmacology, 20:S391,(2010).

Roth and Breaker, "The structural and functional diversity of metabolite-binding riboswitches", Annu Rev Biochem., 78:305-34 (2009).

Roth, et al., "A riboswitch selective for the queuosine precursor preQ1 contains an unusually small aptamer domain", Nature Struct Mol Biol., 14:308-17 (2007).

Samygina, et al., "Reversible inhibition of Escherichia coli inorganic pyrophosphatase by fluoride: trapped catalytic intermediates in cryo-crystallographic studies", J. Mel. Biol.., 366:1305-17 (2006).

Serganov, "The long and the short of riboswitches", Curr. Opin. Struct. Biol., 19:251-9 (2009).

Smith, et al., "Riboswitch RNAs: regulation of gene expression by direct monitoring of a physiological signal", RNA Biol., 7:104-10 (2010).

Stancik, et al., "pH-dependent expression of periplasmic proteins and amino acid catabolism in Escherichia coli", J. Bacteriol., 15:4246-58 (2002).

Stockbridge, et al., "Fluoride resistance and transport by riboswitch-controlled CLC antiporters", PNAS, 109(38):15289-94(2012).

Sudarsan, et al., "Thiamine pyrophosphate riboswitches are targets for the antimicrobial compound pyrithiamine", Chem Biol., 12:1325-35 (2005).

Sudarsan, et al., "Riboswitches in eubacterial sense the second messenger cyclic di-GMP", Science, 321:411-3 (2008).

Sudarsan, et al., "Tandem riboswitch architectures exhibit complex gene control functions", Science, 314:300-4 (2006).

Sudarsan, et al., "An mRNA structure in bacteria that controls gene expression by binding lysine", Genes Dev., 21:2688-97 (2003).

Tempelaars, et al., "Comparative analysis of antimicrobial activities of valinomycin and cereulide, the bacillus cereus emetic toxin", Appl Enviorn Microbiol., 77(8):2755-62 (2011).

Van Loveren, "Antimicrobial activity of fluoride and its in vivo importance: identification of research questions", Caries Res., 35:65-70 (2001).

Vogel, et al., "Fluoride in plaque fluid, plaque, and saliva measured for 2 hours after a sodium fluoride monofluorophosphate rinse", Caries Res., 34:404-11 (2000).

Wachter, et al., "Riboswitch control of gene expression in plants by splicing and alternative 3,, end processing of mRNAs", Plant Cell, 19:3437-50 (2007).

Weinberg, et al., "Comparative genomics reveals 104 candidate structured RNAs from bacteria, archaeal, and their metagenomes", Genome Biol., 11:R31 (2010).

Welz and Breaker, "Ligand binding and gene control characteristics of tandem riboswitches in Bacillus anthracia", RNA, 13:573-82 (2007).

Wickiser, et al., "The speed of RNA transcription and metabolite binding kinetics operate an FMN riboswitch", Mol Cell, 18:49-60 (2005).

Wincott, et al., "Synthesis, deprotection, analysis and purification of RNA and ribozymes", Nucleic Acids Res., 23:2677-84 (1995).

Winkler, et al, "An mRNA structure that controls gene expression by binding FMN", PNAS, 99:15908-13 (2002a).

Winkler, et al., "Thiamine derivatives bind messenger RNAs directly to regulate bacterial gene expression", Nature, 419:952-6 (2002b).

Winkler, et al., "An mRNA structure that controls gene expression by binding S-adenosylmethionine", Nature Struct Biol., 10:701-7 (2003).

Winkler, et al., "Control of gene expression by a natural metabolite-responsive ribozyme", Nature, 428:281-6 (2004).

Zhang, et al., "Ribozymes and riboswitches: modulation of RNA function by small molecules", Biochemistry, 49:9123-31 (2010a).

Zhang, et al., "Crystal structure of the PSPTO-PSP protein from Pseudomonas syringae pv. tomato str. DC3000 in complex with D-glucose" ,Biochem Biophys Res Commun.,397(1):82-6 (2010b).

* cited by examiner

FLUORIDE-RESPONSIVE RIBOSWITCHES, FLUORIDE TRANSPORTERS, AND METHODS OF USE

CROSS REFERENCE TO RELATED APPLICATIONS

This application is a §371 application of the International Application No. PCT/US2012/055745, filed in the United States Receiving Office for the PCT on Sep. 17, 2012, which claims the benefit of and priority to U.S. Provisional Application No. 61/535,965, entitled "Fluoride-Responsive Riboswitches, Fluoride Transporters, and Methods of Use" filed in the United States Patent and Trademark Office on Sep. 17, 2011, the disclosure of which in incorporated herein by reference.

STATEMENT REGARDING FEDERALLY SPONSORED RESEARCH OR DEVELOPMENT

This invention was made with government support under GM022778 awarded by the National Institutes of Health (NIH). The government has certain rights in the invention.

REFERENCE TO SEQUENCE LISTING

The Sequence Listing submitted Mar. 7, 2014, as a text file named "YU_5594_PCT_AMD_AFD_Sequence_Listings.txt," created on Sep. 14, 2012, and having a size of 854,101 bytes is hereby incorporated by reference pursuant to 37 C.F.R. §1.52(e)(5).

FIELD OF INVENTION

The disclosed invention is generally in the field of riboswitches, ion transporters, and regulation of gene expression.

BACKGROUND OF THE INVENTION

Fluoride can be both beneficial and toxic. For years fluoride has been used in oral hygiene for its beneficial effects in products such as toothpaste and mouthwash. On the other hand, a build up of fluoride in a cell can be toxic. Therefore, appropriate amounts of fluoride and careful regulation of fluoride in cells is essential.

A key biochemical component of a bacterial cell's fluoride surveillance and response system is the new-found fluoride-responsive riboswitch class based on the crcB motif (Weinberg et al. 2010. Comparative genomics reveals 104 candidate structured RNAs from bacteria, archaeal, and their metagenomes. Genome Biol 11:R31). The general architectures and functional mechanisms for fluoride riboswitches are similar to many other known riboswitch classes. Members of each riboswitch class carry at least one ligand-binding "aptamer" domain and one adjoining "expression platform" domain that together control expression of the downstream gene(s) by one of several known mechanisms (Wickiser et al. 2005. The speed of RNA transcription and metabolite binding kinetics operate an FMN riboswitch. Mol Cell 18:49-60; Barrick and Breaker, 2007. The distributions, mechanisms, and structures of metabolite-binding riboswitches. Genome Biol 8:R239). The most common mechanisms used by bacteria include transcription termination and translation initiation, although some bacterial riboswitch classes exploit other mechanisms such as allosteric ribozyme-mediated splicing (Lee et al. 2010. An allosteric self-splicing ribozyme triggered by a bacterial second messenger. Science 329:845-848) and coenzyme-dependent ribozyme self-cleavage (Winkler W C, et al. 2004. Control of gene expression by a natural metabolite-responsive ribozyme. Nature 428:281-286).

Ligands for these riboswitches include fundamental metabolites such as coenzymes, amino acids, nucleobases and their derivatives, and amino sugars (Roth A, Breaker R R. 2009. The structural and functional diversity of metabolite-binding riboswitches. Annu Rev Biochem 78:305-334; Breaker R R. 2011. Riboswitches and the RNA World. In: RNA Worlds. J F Atkins, R F Gesteland, T R Cech, eds. CSH Press). Moreover, riboswitches with striking biochemical properties [e.g. ribozyme-based gene regulation (Lee E R, et al. 2010. An allosteric self-splicing ribozyme triggered by a bacterial second messenger. Science 329:845-848; Winkler W C, et al. 2004. Control of gene expression by a natural metabolite-responsive ribozyme. Nature 428:281-286); digital regulation by either cooperative ligand binding (Mandal M, et al. 2004. A glycine-dependent riboswitch that uses cooperative binding to control gene expression. Science 306:275-279) or by tandem riboswitch function (Welz R, Breaker R R. 2007. Ligand binding and gene control characteristics of tandem riboswitches in *Bacillus anthracis*. RNA 13:573-582); two-input logic gates (Sudarsan N, et al. 2006. Tandem riboswitch architectures exhibit complex gene control functions. Science 314:300-304)] have been discovered as well as others that expose critical biological circuitry [e.g. bacterial second messenger sensing (Sudarsan N, et al. 2008. Riboswitches in eubacterial sense the second messenger cyclic di-GMP. Science 321:411-413; Lee E R, et al. 2010. An allosteric self-splicing ribozyme triggered by a bacterial second messenger. Science 329:845-848); coenzyme-mediated alternative splicing control in eukaryotes (Cheah et al. 2007. Control of alternative RNA splicing and gene expression by eukaryotic riboswitches. Nature 447:497-501; Wachter et al. 2007. Riboswitch control of gene expression in plants by splicing and alternative 3' end processing of mRNAs. Plant Cell 19:3437-3450)]. Furthermore, the first datasets that validate riboswitches as targets for antibacterial and antifungal agents have been provided (Sudarsan et al. 2005. Thiamine pyrophosphate riboswitches are targets for the antimicrobial compound pyrithiamine. Chem Biol 12:1325-1335; Blount K F, et al. 2007. Antibacterial lysine analogs that target lysine riboswitches. Nature Chem Biol 3:44-49; Kim J N, et al. 2009. Design and antimicrobial action of purine analogues that bind guanine riboswitches. ACS Chem Biol 4:915-927; Lee E R, et al. 2009. Roseoflavin is a natural antibacterial compound that binds to FMN riboswitches and regulates gene expression. RNA Biol 6:187-194; Blount K F, Breaker R R. 2007. Riboswitches as antibacterial drug targets. Nature Biotechnol 24:1558-1564). However, the identification of a fluoride-responsive riboswitch ranks as one of the most intriguing discoveries among this collection of riboswitch science advances.

Riboswitches are structured RNA domains commonly located in the 5' untranslated regions (UTRs) of messenger RNAs where they selectively bind target metabolites (or ions in rare instances) and regulate gene expression (Mandal M, Breaker R R. 2004. Gene regulation by riboswitches. Nature Rev Mol Cell Biol 5:451-463; Roth A, Breaker R R. 2009. The structural and functional diversity of metabolite-binding riboswitches. Annu Rev Biochem 78:305-334; Smith A M, et al. 2010. Riboswitch RNAs: regulation of gene expression by direct monitoring of a physiological signal. RNA Biol 7:104-110). Recently a natural fluoride-responsive riboswitch class was discovered that offers an unprecedented opportunity to establish the molecular basis for fluoride sensing in organisms distributed among two of the three domains of life. Also, for the first time, strategies for fluoride toxicity alleviation in many species can be revealed.

The discovery of fluoride-responsive riboswitches exposes a widespread sensor and toxic response system for fluoride—an anion whose mechanisms of toxicity in bacteria and mechanisms of efficacy in humans remain incompletely defined. Reporter systems can be developed that detect the in vivo concentration of this toxic ion. Furthermore, such reporters can be used to identify compounds that influence fluoride uptake and retention, which has great potential for basic research and therapeutics development.

The discovery has immediate implications for understanding the health effects of fluoride additives in water and dental hygiene products. These studies involve the creation and exploitation of tools to sense and manipulate cellular fluoride concentrations. Systems that report the in vivo concentration of fluoride for high throughput (HTP) screening use and create compounds that manipulate these fluoride levels are disclosed. Of particular interest is the identification and optimization of compounds that can be used to sensitize cells to the effects of fluoride via fluoride transporter blocking, thus enhancing the antimicrobial action of this anion.

The disclosed invention provides compositions and methods for demonstrating compatibility of a riboswitch-reporter fusion system that measures cytoplasm fluoride concentrations and permits HTP screening for fluoride transporter inhibitors.

The disclosed invention further provides compositions and methods for using a riboswitch-reporter fusion system in HTP screens to identify compounds that increase fluoride concentrations in bacteria. Fluoride transporter inhibitors or fluoride uptake/diffusion facilitators can be identified by measuring the increase in reporter activity under otherwise non-permissive fluoride concentrations in media.

The disclosed invention further provides compounds and methods for establishing the mechanisms of various compounds which allow for the classification of targets for the future development of fluoride concentration agonists.

The disclosed invention further provides compounds and methods for determining the pharmacophore of fluoride transporter inhibitors and other fluoride agonist compounds. This can yield insight into the critical substructures of the active compounds and permit the synthesis and analysis of derivative compounds that can have improved efficacy.

The disclosed invention provides compositions and methods to identify novel riboswitch-targeting compounds in Gram positive organisms. The methods used to identify, characterize and enhance compounds that influence fluoride concentrations in cells can also be used to discover compounds that inhibit fluoride riboswitches other riboswitch classes. Such compounds could become leads for novel antimicrobial agents.

The disclosed invention further provides fluoride binding aptamers that can be used alone or in combination with an expression platform domain.

SUMMARY OF THE INVENTION

Disclosed are compounds, compositions, and methods relating to fluoride aptamers, fluoride-responsive riboswitches, fluoride-regulated expression constructs, fluoride transporters, nucleic acids encoding fluoride transporters, expression constructs encoding fluoride transporters, and cells containing or including any combination of these. The disclosed compounds, compositions and methods have numerous uses. For example, fluoride aptamers are useful for binding, sensing, detecting, sequestering, etc., fluoride. Fluoride aptamers are also useful in, for example, fluoride-responsive riboswitches. Fluoride-responsive riboswitches are useful, for example, modulating or regulating expression of genes and nucleic acid molecules encoding or comprising such riboswitches. Fluoride aptamers, fluoride-responsive riboswitches, and genes and nucleic acid molecules comprising fluoride aptamers or fluoride-responsive riboswitches are useful, for example, as targets for compounds and compositions that affect such fluoride aptamers, fluoride-responsive riboswitches, and genes and nucleic acid molecules comprising fluoride aptamers or fluoride-responsive riboswitches. For example, the expression of genes regulated by fluoride-responsive riboswitches can be affected. This can result in, for example, inhibition, stasis, or death of cells containing the riboswitches. In this way, the disclosed compounds can have antimicrobial and anti-cellular effects. Fluoride-responsive riboswitches can also be used to regulate expression of expression products of interest, including, for example, production of expression products.

Because the disclosed fluoride-responsive riboswitches and fluoride transporters are involved in regulation of fluoride levels in cells, and because fluoride can have toxic effects on cells, stimulating, increasing, etc. the function, expression, levels, etc. of fluoride-responsive riboswitches and/or fluoride transporters can improve, increase, etc. a cell's ability to grow, survive, etc. in the presence of fluoride. Similarly, inhibiting, decreasing, etc. the function, expression, levels, etc. of fluoride-responsive riboswitches and/or fluoride transporters can harm, decrease, etc. a cell's ability to grow, survive, etc. in the presence of fluoride. Thus, for example, disclosed compounds, compositions and methods can be used to kill, inhibit, etc. cells and/or make fluoride more effective at killing, inhibiting, etc. such cells. Stimulating, increasing, etc. the function, expression, levels, etc. of fluoride-responsive riboswitches and/or fluoride transporters can be used, for example, make cells more resistant to fluoride. This can be useful, for example, in organisms intended to function in high fluoride environments. For example, cells that are designed, intended, used for, etc. detoxifying organic molecules, especially halogen- or fluorine-containing organic compounds, can benefit from the disclosed compositions and methods.

In particular, disclosed are fluoride aptamer nucleic acid molecules comprising a fluoride aptamer. The fluoride aptamer nucleic acid molecule can further comprise (a) one or more sequences heterologous to the fluoride aptamer, (b) a heterologous component conjugated to the nucleic acid molecule, or (c) both. In some forms, the fluoride aptamer can be derived from a naturally-occurring fluoride-responsive riboswitch. In some forms, the fluoride aptamer nucleic acid molecule can further comprise a sequestration tag. In some forms, the sequestration tag can be used to separate the fluoride aptamer nucleic acid molecule from a mixture. In some forms, the heterologous component can comprise the sequestration tag.

In some forms, the fluoride aptamer nucleic acid molecule can further comprise an expression platform domain operably linked to the fluoride aptamer. In some forms, the fluoride aptamer and the expression platform domain can constitute a fluoride-responsive riboswitch. In some forms, the fluoride aptamer can constitute the aptamer domain of the fluoride-responsive riboswitch. In some forms, the fluoride-responsive riboswitch can be derived from a naturally-occurring fluoride-responsive riboswitch. In some forms, the expression platform domain can be derived from a naturally-occurring riboswitch. In some forms, the expression platform domain can be derived from a naturally-occurring fluoride-responsive riboswitch. In some forms, the expression platform domain can be heterologous to the fluoride aptamer.

In some forms, the fluoride aptamer can be operably linked to a signal-generating component, wherein the signal-generating component generates a signal when the fluoride aptamer is bound by fluoride. In some forms, the aptamer and the signal-generating component can be heterologous. In some forms, the aptamer and the signal-generating component can be heterologous to each other. In some forms, the fluoride aptamer nucleic acid molecule can be encoded by and expressed from a gene.

Also disclosed are fluoride-regulated expression constructs comprising a nucleic acid molecule encoding one or more of the disclosed fluoride aptamer nucleic acid molecules. In some forms, the fluoride-responsive riboswitch can be operably linked to a coding region, whereby expression of the coding region can be regulated by the riboswitch. In some forms, the riboswitch and coding region can be heterologous. In some forms, the riboswitch and coding region can be heterologous to each other. In some forms, expression of the coding region can produce a signal. In some forms, expression of the coding region can induce or cause death of the cell in which it is expressed. In some forms, expression of the coding region can induce or cause stasis of the cell in which it is expressed.

Also disclosed are cells comprising one or more of the disclosed fluoride-regulated expression constructs. In some forms, expression of the coding region can be regulated by fluoride. In some forms, expression of the coding region can produce a signal, whereby the signal indicates the presence of fluoride in the cell. In some forms, the coding region can encode an expression product, where production of the expression product by the cell is regulated by fluoride. In some forms, expression of the coding region can induce or cause death of the cell. In some forms, expression of the coding region can induce or cause stasis of the cell. Also disclosed are cells comprising one or more of the disclosed fluoride aptamer nucleic acid molecules.

Also disclosed are methods of sensing fluoride, the method comprising bringing into contact a sample or an environment to be assessed and one or more of the disclosed cells, where the cells comprise one or more of the disclosed fluoride-regulated expression constructs, where expression of the coding region produces a signal, where the signal indicates the presence of fluoride in the sample or environment.

Also disclosed are methods of sensing fluoride, the method comprising bringing into contact a sample or an environment to be assessed and one or more of the disclosed cells, where the cells comprise one or more of the disclosed fluoride aptamer nucleic acid molecules, where the fluoride aptamer is operably linked to a signal-generating component, where the signal-generating component generates a signal when the fluoride aptamer is bound by fluoride, where the signal indicates the presence of fluoride in the sample or environment.

Also disclosed are methods of sensing fluoride, the method comprising bringing into contact a sample or an environment to be assessed and one or more of the disclosed fluoride aptamer nucleic acid molecules, where the signal indicates the presence of fluoride in the sample or environment.

In some forms, the level of signal produced can indicate the level of fluoride in the sample or the environment.

Also disclosed are methods of separating fluoride from a mixture, the method comprising bringing into contact the mixture and one or more of the disclosed fluoride aptamer nucleic acid molecules, where the fluoride aptamer nucleic acid molecule comprises a sequestration tag, and separating the fluoride aptamer nucleic acid molecule from the mixture via the sequestration tag, thereby separating fluoride from the mixture.

In some forms, the fluoride aptamer nucleic acid molecule can be separated by bringing into contact the fluoride aptamer nucleic acid molecule and a solid support comprising a binding agent, where the binding agent binds the sequestration tag. In some forms, bringing into contact the mixture and the fluoride aptamer nucleic acid molecule and bringing into contact the fluoride aptamer nucleic acid molecule and the solid support are together accomplished by passing the mixture through or over the solid support, where the solid support comprises the fluoride aptamer nucleic acid molecule, where the fluoride aptamer nucleic acid molecule is conjugated to the solid support via the sequestration tag. In some forms, following bringing into contact the fluoride aptamer nucleic acid molecule and the solid support, the solid support can be washed.

Also disclosed are methods of separating fluoride from a mixture, the method comprising bringing into contact the mixture and a solid support, wherein the solid support comprises one or more of the disclosed fluoride aptamer nucleic acid molecules, and separating the mixture from the solid support, thereby separating fluoride from the mixture.

Also disclosed are methods of separating fluoride from a mixture, the method comprising bringing into contact the mixture and one or more of the disclosed cells, where the cells comprise one or more of the disclosed fluoride aptamer nucleic acid molecules, where the fluoride aptamer nucleic acid molecule is sequestered in an inclusion body, thereby separating fluoride from the mixture.

In some forms, the fluoride aptamer nucleic acid molecule can be sequestered in an inclusion body via a sequestration tag. In some forms, the cell can be separated from the mixture.

Also disclosed are methods of regulating gene expression, the method comprising bringing into contact fluoride and one or more of the disclosed cells, where the cells comprise one or more of the disclosed fluoride-regulated expression constructs, whereby the fluoride alters the expression of the coding region. In some forms, the level of expression can vary based on the level of fluoride.

Also disclosed are methods of regulating gene expression, the method comprising bringing into contact a compound and one or more of the disclosed cells, where the cells comprise one or more of the disclosed fluoride-regulated expression constructs, where the compound alters the expression of the fluoride-responsive riboswitch. In some forms, the compound can inhibit activation of the fluoride-responsive riboswitch by fluoride. In some forms, the compound can activate the fluoride-responsive riboswitch.

Also disclosed are methods of producing an expression product, the method comprising bringing into contact fluoride and one or more of the disclosed cells, where the cells comprise one or more of the disclosed fluoride-regulated expression constructs, whereby the expression product is produced via expression of the fluoride-regulated expression construct.

Also disclosed are methods of controlling cells, the method comprising exposing one or more of the disclosed cells to fluoride, thereby causing the cell to die, where the cells comprise one or more of the disclosed fluoride-regulated expression constructs, where expression of the coding region induces or causes death of the cell.

Also disclosed are methods of controlling cells, the method comprising exposing one or more of the disclosed cells to fluoride, thereby causing the cell to enter stasis, where the cells comprise one or more of the disclosed fluoride-regulated expression constructs, where expression of the coding region induces or causes stasis of the cell.

Also disclosed are methods of altering gene expression, the method comprising bringing into contact a compound and a cell, wherein the cell comprises a gene encoding an RNA comprising a fluoride-responsive riboswitch, wherein the compound affects expression of the riboswitch.

Also disclosed are methods of altering gene expression, the method comprising bringing into contact fluoride and a cell, wherein the cell comprises a gene encoding an RNA comprising a fluoride-responsive riboswitch, wherein fluoride affects expression of the riboswitch.

In some forms, the level of expression can vary based on the level of fluoride. In some forms, the compound can inhibit activation of the fluoride-responsive riboswitch by fluoride. In some forms, the compound can activate the fluoride-responsive riboswitch.

Also disclosed are methods of identifying compounds that affect expression of fluoride-responsive riboswitches, the method comprising testing a compound for altering gene expression of one or more of the disclosed fluoride-regulated expression constructs, where the alteration is via the riboswitch, where alteration of expression of the fluoride-regulated expression construct identifies the compound as a compound that affects expression of the fluoride-responsive riboswitch.

In some forms, expression of the coding region can produce a signal, where the signal identifies the compound as a compound that affects expression of the fluoride-responsive riboswitch. In some forms, the compound can inhibit activation of the fluoride-responsive riboswitch by fluoride. In some forms, the compound can activate the fluoride-responsive riboswitch. In some forms, the fluoride-regulated expression constructs can be in a cell.

Also disclosed are methods of identifying compounds that affect fluoride aptamers, the method comprising testing a compound for affecting one or more of the disclosed fluoride aptamers, where the fluoride aptamer is operably linked to a signal-generating component, where the signal-generating component generates a signal when the fluoride aptamer is bound by fluoride, where a change in the signal identifies the compound as a compound that affects the fluoride aptamer.

Also disclosed are methods of identifying compounds that affect fluoride aptamers, the method comprising testing a compound for affecting one or more of the disclosed fluoride aptamers, where the fluoride aptamer is operably linked to a signal-generating component, where the signal-generating component generates a signal when the fluoride aptamer is bound by fluoride, where a change in the signal identifies the compound as a compound that affects the fluoride aptamer.

In some forms, the compound can inhibit activation of the fluoride aptamer by fluoride. In some forms, the compound can activate the fluoride aptamer. In some forms, the fluoride aptamers can be comprised in one or more of the disclosed fluoride aptamer nucleic acid molecules. In some forms, the fluoride aptamers can be in a cell.

Also disclosed are expression constructs that encodes a fluoride transporter. Also disclosed are cells comprising one or more of the disclosed expression constructs that encodes a fluoride transporter, where the fluoride transporter is heterologous to the cell. Also disclosed are recombinant cells comprising one or more of the disclosed expression constructs that encodes a fluoride transporter.

In some forms, the fluoride transporter can be a bacterial fluoride transporter, archaeal fluoride transporter, eukaryotic fluoride transporter, fungal fluoride transporter, or plant fluoride transporter. In some forms, the fluoride transporter can be derived from a gene that is regulated by a fluoride-responsive riboswitch. In some forms, the fluoride transporter can be derived from a gene that is regulated by a riboswitch, where the riboswitch comprises a crcB motif. In some forms of the disclosed cells, the expression construct can comprise a fluoride-responsive riboswitch, where the fluoride-responsive riboswitch is operably linked to a coding region, where expression of the coding region is regulated by the riboswitch, where the coding region encodes one or more of the disclosed fluoride transporters.

Also disclosed are compounds that inhibit a fluoride transporter. In some forms, the compound has the structure

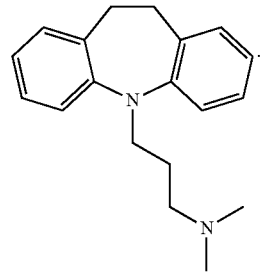 [SMILES: CN(C)CCCN1c2ccccc2CCc2ccccc21 ; "."]

Also disclosed are methods for identifying compounds that increases fluoride concentration in a cell, the method comprising detecting fluoride concentration in a cell in the presence and in the absence of a test compound, wherein an increase in fluoride concentration in the presence of the test compound identifies the test compound as a compound that increases fluoride concentration in the cell.

In some forms, the cell can comprise a fluoride-sensing element. In some forms, the fluoride-sensing element can comprise a fluoride-regulated expression construct comprising a nucleic acid molecule encoding a fluoride-responsive riboswitch operably linked to a coding region, where expression of the coding region is regulated by the riboswitch, where expression of the coding region produces a signal, where the signal indicates the presence of fluoride in the cell. In some forms, the fluoride-sensing element can comprise a fluoride aptamer operably linked to a signal-generating component, where the signal-generating component generates a signal when the fluoride aptamer is bound by fluoride, where the signal indicates the presence of fluoride in the cell. In some forms, the cell can lack a native fluoride transporter. In some forms, the cell can comprise a heterologous fluoride transporter.

In some forms of the methods, the fluoride concentration in a second cell can be detected in the presence and in the absence of the test compound, where the second cell lacks a fluoride transporter. In some forms, a higher fluoride concentration in the first cell in the presence of the test compound as compared to the fluoride concentration in the second cell in the presence of the test compound can identify the test compound as a compound that enhances fluoride uptake by the cell. In some forms, a substantially similar fluoride concentration in the first cell and the second cell in the presence of the test compound can identify the test compound as a compound that inhibits fluoride transport by the fluoride transporter.

Also disclosed are methods for identifying compounds that inhibit fluoride transport by fluoride transporters, the method comprising detecting fluoride transport by a fluoride transporter in the presence and in the absence of a test compound, where a reduction in fluoride transport in the presence of the test compound identifies the test compound as a compound that inhibits fluoride transport by the fluoride transporter. In some forms, the fluoride transport can be fluoride transport out of a cell, where the cell comprises the fluoride transporter, where the fluoride transporter is heterologous to the cell.

Also disclosed are methods of growing cells, the method comprising incubating one or more of the disclosed cells in the presence of a high fluoride concentration, where the cell comprises one or more of the disclosed expression constructs that encodes a fluoride transporter. In some forms, the fluoride transporter can be heterologous to the cell. In some forms, the cell is capable of degrading at least one fluorinated compound, where degradation of the fluorinated compound contributes to or creates the high fluoride concentration. In some forms, the cell comprises at least one heterologous enzyme involved in degradation of fluorinated compounds.

Also disclosed are methods of inhibiting a fluoride transporter, the method comprising bringing into contact the fluoride transporter and a compound that inhibits a fluoride transporter, wherein the compound has the structure

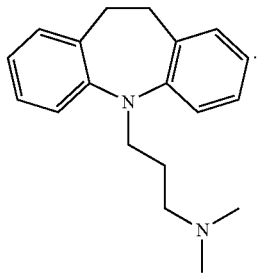 [SMILES: CN(C)CCCN1c2ccccc2CCc2ccccc21 ; "."]

Also disclosed are methods for increasing the concentration of fluoride in a cell, the method comprising bringing into contact the cell and one or more compounds identified by any one of the disclosed methods for identifying compounds that increases fluoride concentration in a cell.

Also disclosed are methods for increasing the concentration of fluoride in a cell, the method comprising bringing into contact the cell and one or more compounds identified by any one of the disclosed methods for identifying compounds that that affect expression of fluoride-responsive riboswitches.

Also disclosed are compositions that enhance fluoride toxicity. In some forms, the composition can comprise one or more of the disclosed compounds. In some forms, the compound can be a compound identified by any one of the disclosed methods for identifying compounds that increases fluoride concentration in a cell, by any one of the disclosed methods for identifying compounds that that affect expression of fluoride-responsive riboswitches, or both.

In some forms, the composition can comprise a compound that inhibits a fluoride transporter. In some forms, the compound has the structure

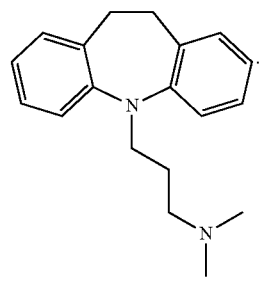

In some forms, the composition can comprise a compound that inhibits activation of a fluoride-responsive riboswitch. In some forms, the composition can comprise a compound that increases permeability of a cell membrane to fluoride. In some forms, the composition can comprise a compound that binds to fluoride and that facilitates passage of fluoride through a cell membrane to fluoride. In some forms, the compound has the structure

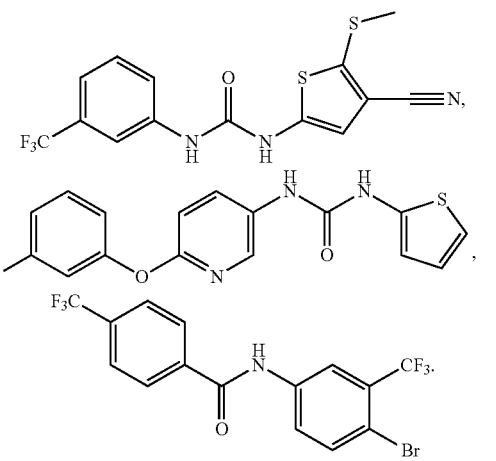

In some forms, the composition can further comprise a carrier. In some forms, the carrier can comprise a cream, paste, fluid, coating, paint, spray, detergent, or a combination. In some forms, the composition can further comprise an antimicrobial agent. In some forms, the composition can further comprise a bioavailable form of fluoride. In some forms, the carrier can comprise antimicrobial cream, antimicrobial paste, antimicrobial fluid, antimicrobial coating, antimicrobial paint, antimicrobial spray, antimicrobial detergent, antimicrobial soap, mouthwash, skinwash, nasal wash, toothpaste, toothwash, dish detergent, laundry detergent, dishwasher detergent, nasal spray, mouth spray, throat spray, skin spray, douche fluid, enema fluid, wound cleanser, wound covering, eyewash, shampoo, facial wash, facial cream, or facial soap. In some forms, the composition can be an additive for addition to food or a product.

Also disclosed are objects and substances comprising one or more of the disclosed compositions. In some forms, the composition can increase preservation of the object or substance. In some forms, the composition can reduce microbes on or in proximity to the object or substance.

Additional advantages of the disclosed method and compositions will be set forth in part in the description which follows, and in part will be understood from the description, or may be learned by practice of the disclosed method and compositions. The advantages of the disclosed method and compositions will be realized and attained by means of the elements and combinations particularly pointed out in the appended claims. It is to be understood that both the foregoing general description and the following detailed description are exemplary and explanatory only and are not restrictive of the invention as claimed.

BRIEF DESCRIPTION OF THE DRAWINGS

The accompanying drawings, which are incorporated in and constitute a part of this specification, illustrate several embodiments of the disclosed method and compositions and together with the description, serve to explain the principles of the disclosed method and compositions.

DETAILED DESCRIPTION OF THE INVENTION

Figure 1A:
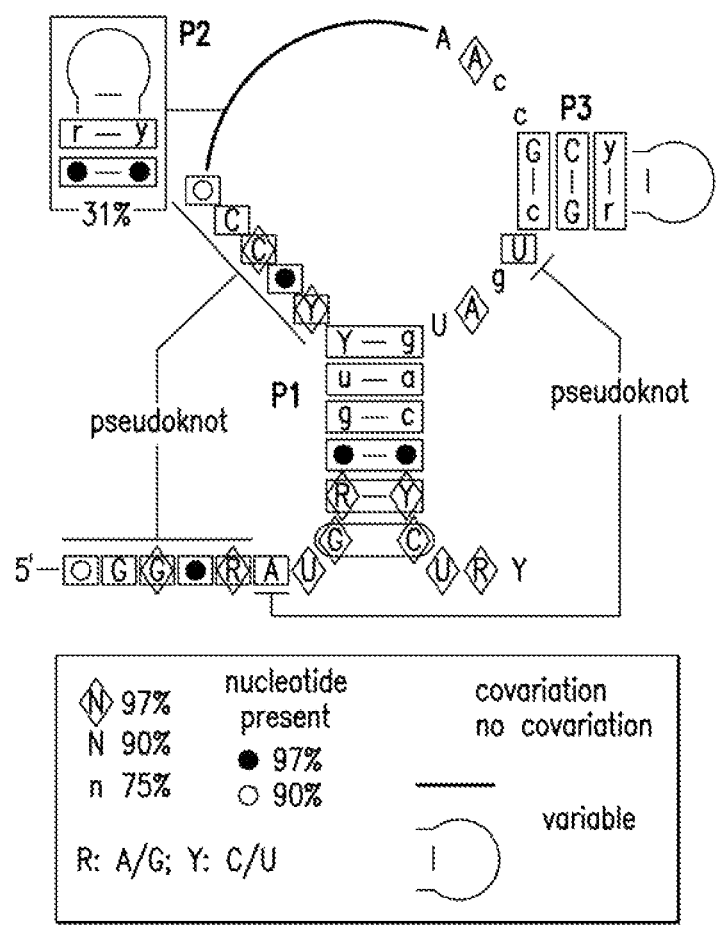
FIGS. 1A (SEQ ID NO:348), 1B, and 1C show the consensus for crcB motif RNAs and selective fluoride binding by a riboswitch aptamer from *Pseudomonas syringae*. (A) Consensus sequence and structural model is based on the comparison of 2188 representatives from bacterial and archaeal species. P1, P2, P3 and pseudoknot labels identify base-paired substructures. Note that the bottom of P1 carries a possible G-C pair. However, because non-complementary nucleotides occur in these positions in some representatives, these nucleotides are depicted as unpaired. (B) Sequence and secondary structure model for the WT 78 Psy RNA (SEQ ID NO:349). Numbers 1, 2, 3, 4, 5, and 6 depict the sites of the in-line probing analysis; results presented in C. The two G residues preceding nucleotide 1 were added to facilitate RNA production by in vitro transcription. (C) Plot of the normalized fraction of RNA cleavage versus the logarithm of fluoride ion concentration (molar). Curves represent those expected for 1-to-1 binding with a $K_D$ of 60 µM. Data is obtained from C.

The disclosed method and compositions may be understood more readily by reference to the following detailed description of particular embodiments and the Examples included therein and to the Figures and their previous and following description.

Disclosed are compounds, compositions, and methods relating to fluoride aptamers, fluoride-responsive riboswitches, fluoride-regulated expression constructs, fluoride transporters, nucleic acids encoding fluoride transporters, expression constructs encoding fluoride transporters, and cells containing or including any combination of these. The disclosed compounds, compositions and methods have numerous uses. For example, fluoride aptamers are useful for binding, sensing, detecting, sequestering, etc., fluoride. Fluoride aptamers are also useful in, for example, fluoride-responsive riboswitches. Fluoride-responsive riboswitches are useful, for example, modulating or regulating expression of genes and nucleic acid molecules encoding or comprising such riboswitches. Fluoride aptamers, fluoride-responsive riboswitches, and genes and nucleic acid molecules comprising fluoride aptamers or fluoride-responsive riboswitches are useful, for example, as targets for compounds and compositions that affect such fluoride aptamers, fluoride-responsive riboswitches, and genes and nucleic acid molecules comprising fluoride aptamers or fluoride-responsive riboswitches. For example, the expression of genes regulated by fluoride-responsive riboswitches can be affected. This can result in, for example, inhibition, stasis, or death of cells containing the riboswitches. In this way, the disclosed compounds can have antimicrobial and anti-cellular effects. Fluoride-responsive riboswitches can also be used to regulate expression of expression products of interest, including, for example, production of expression products.

Because the disclosed fluoride-responsive riboswitches and fluoride transporters are involved in regulation of fluoride levels in cells, and because fluoride can have toxic effects on cells, stimulating, increasing, etc. the function, expression, levels, etc. of fluoride-responsive riboswitches and/or fluoride transporters can improve, increase, etc. a cell's ability to grow, survive, etc. in the presence of fluoride. Similarly, inhibiting, decreasing, etc. the function, expression, levels, etc. of fluoride-responsive riboswitches and/or fluoride transporters can harm, decrease, etc. a cell's ability to grow, survive, etc. in the presence of fluoride. Thus, for example, disclosed compounds, compositions and methods can be used to kill, inhibit, etc. cells and/or make fluoride more effective at killing, inhibiting, etc. such cells. Stimulating, increasing, etc. the function, expression, levels, etc. of fluoride-responsive riboswitches and/or fluoride transporters can be used, for example, make cells more resistant to fluoride. This can be useful, for example, in organisms intended to function in high fluoride environments. For example, cells that are designed, intended, used for, etc. detoxifying organic molecules, especially halogen- or fluorine-containing organic compounds, can benefit from the disclosed compositions and methods.

It is to be understood that the disclosed method and compositions are not limited to specific synthetic methods, specific analytical techniques, or to particular reagents unless otherwise specified, and, as such, may vary. It is also to be understood that the terminology used herein is for the purpose of describing particular embodiments only and is not intended to be limiting.

Compositions

Disclosed herein is a widespread riboswitch class (Weinberg et al. 2010. Comparative genomics reveals 104 candidate structured RNAs from bacteria, archaeal, and their metagenomes. Genome Biol 11:R31) whose members bind fluoride ions and regulate numerous fluoride toxicity mitigation genes. Also disclosed are fluoride binding aptamers. The discovery provides extraordinary insight into cellular strategies for fluoride sensing and toxicity mitigation. This discovery also provides opportunities to develop sensors for measuring fluoride concentrations in vitro and in vivo. More importantly, it is now recognized that most bacterial, archaeal and fungal species express specific genes to overcome fluoride toxicity, which reveals numerous possibilities for antimicrobial agent development.

Fluoride is widely used as an additive to drinking water and oral hygiene products due to its efficacy in preventing tooth decay. One proposed mechanism of fluoride action is its antibacterial activity at high concentrations in dental plaque (Koo, Adv Dent Res 20:17-21, 2008; Hamilton, J Dent Res 69:660-667, 1990; Van Loveren. Caries Res 34:404-411, 2001; Marquis et al. FEMS Microbiol Rev 26:189-194, 2003; Maltz et al. J Dent Res 61:786-790, 1982). Genetic reporter constructs are disclosed that can be used to establish the cellular concentrations of fluoride ions in bacterial cells. These constructs can be used to conduct high-throughput (HTP) screens for compounds that enhance bacterial fluoride uptake and/or retention. Compound mechanisms can be assessed and their efficacy improved by using Structure-Activity Relationship (SAR) studies. These studies help assess the long-standing hypothesis that the antibacterial activity of fluoride prevents dental caries and broaden the utility of fluoride by using compounds that enhance its toxicity.

A. Fluoride Aptamers

It has been discovered that a class of riboswitches include aptamer domains that bind to fluoride ions (the riboswitches are activated by fluoride). Fluoride aptamers are nucleic acid molecules that can specifically bind to fluoride ions. It is understood that fluoride aptamers include nucleic acid molecules that bind fluoride as the anion alone or fluoride with a counterion. Fluoride aptamers generally can be naturally-occurring fluoride aptamers, such as fluoride aptamers in naturally-occurring fluoride-responsive riboswitches, and fluoride aptamers derived from naturally-occurring fluoride aptamers. These aptamer domains and aptamers derived from them can be used for a variety of purposes, as is described herein. As used herein, "naturally-occurring" refers to a compound, molecule, structure, cell, organism, etc. that occurs in nature and was not specifically altered by man. For example, disclosed are fluoride aptamer nucleic acid molecules comprising a fluoride aptamer. The fluoride aptamer nucleic acid molecule can further comprise (a) one or more sequences heterologous to the fluoride aptamer, (b) a heterologous component conjugated to the nucleic acid molecule, or (c) both. In some forms, the fluoride aptamer can be derived from a naturally-occurring fluoride-responsive riboswitch. In some forms, the fluoride aptamer nucleic acid molecule can further comprise a sequestration tag. In some forms, the sequestration tag can be used to separate the fluoride aptamer nucleic acid molecule from a mixture. In some forms, the heterologous component can comprise the sequestration tag.

Fluoride aptamer nucleic acid molecules are nucleic acid molecules that include a fluoride aptamer. Generally, fluoride aptamer nucleic acid molecules will include at least one other component, such as additional nucleic acid sequences or components directly or indirectly conjugated to the fluoride aptamer. As used herein, "conjugated to" includes covalent coupling and non-covalent binding or interaction. As used herein, "component" refers to any named or identifiable object, such as ions, elements, compounds, molecules, structures, conjugates, cells, tissues, organs, organisms, products, objects, etc. The nature of a component generally will be understood in the context in which it is used.

As used herein, a component (such as a fluoride aptamer) can be said to be heterologous to a different component (such as a coding region) if they are not operably linked in nature. For example, fluoride aptamers and coding regions from different sources, such as different genes, different chromosomes, different organisms, and the like, can be said to be heterologous. As another example, riboswitches and coding regions from different sources, such as different genes, different chromosomes, different organisms, and the like, can be said to be heterologous. As another example, aptamer domains and expression platform domains from different sources, such as different riboswitches, different genes, different chromosomes, different organisms, and the like, can be said to be heterologous. As another example, fluoride aptamers and sequences from different sources, such as different genes, different chromosomes, different organisms, and the like, can be said to be heterologous. As another example, riboswitches and sequences from different sources, such as different genes, different chromosomes, different organisms, and the like, can be said to be heterologous. As another example, fluoride aptamers and expression platform domains from different sources, such as different genes, different chromosomes, different organisms, and the like, can be said to be heterologous. As another example, aptamers and signal-generating components from different sources, such as different genes, different chromosomes, different organisms, and the like, can be said to be heterologous. As another example, fluoride aptamers and cells from different sources, such as different organisms, and the like, can be said to be heterologous. As another example, fluoride transporters and cells from different organisms, and the like, can be said to be heterologous. As another example, fluoride transporter genes and cells from different organisms, and the like, can be said to be heterologous. As another example, enzymes and cells from different organisms, and the like, can be said to be heterologous.

As used herein, when a component is referred to as being "derived from" another component refers (in the cases of components of like kind) to the first component being an altered form of the second component or (in cases of components of different kind) to the first component being removed, separated, taken out of, etc. the second component. For example, a fluoride aptamer that is derived form a naturally-occurring fluoride aptamer can be an altered form of the naturally-occurring fluoride aptamer. As another example, a fluoride aptamer that is derived from a fluoride-responsive riboswitch can be the aptamer domain of the riboswitch removed or separated from the riboswitch (such a derived fluoride aptamer could in addition be altered from the aptamer as it exists in the riboswitch).

In some forms, the fluoride aptamer nucleic acid molecule can further comprise an expression platform domain operably linked to the fluoride aptamer. In some forms, the fluoride aptamer and the expression platform domain can constitute a fluoride-responsive riboswitch. In some forms, the fluoride aptamer can constitute the aptamer domain of the fluoride-responsive riboswitch. In some forms, the fluoride-responsive riboswitch can be derived from a naturally-occurring fluoride-responsive riboswitch. In some forms, the expression platform domain can be derived from a naturally-occurring riboswitch. In some forms, the expression platform domain can be derived from a naturally-occurring fluoride-responsive riboswitch. In some forms, the expression platform domain can be heterologous to the fluoride aptamer.

In some forms, the fluoride aptamer can be operably linked to a signal-generating component, wherein the signal-generating component generates a signal when the fluoride aptamer is bound by fluoride. In some forms, the aptamer and the signal-generating component can be heterologous. In some forms, the aptamer and the signal-generating component can be heterologous to each other. In some forms, the fluoride aptamer nucleic acid molecule can be encoded by and expressed from a gene.

B. Fluoride-Responsive Riboswitches

Disclosed are fluoride-responsive riboswitches. Fluoride-responsive riboswitches are riboswitches that can be activated by fluoride. Fluoride responsive-riboswitches comprise a fluoride aptamer and an expression platform domain. The fluoride-responsive riboswitch can be a naturally-occurring fluoride-responsive riboswitch, derived from a naturally-occurring fluoride-responsive riboswitch, comprised of a fluoride aptamer from or derived from a naturally-occurring fluoride-responsive riboswitch, comprised of one of the disclosed fluoride aptamers, etc. The fluoride aptamer and the expression platform domain can constitute a fluoride-responsive riboswitch. Any of the disclosed fluoride aptamers can constitutes the aptamer domain of a fluoride-responsive riboswitch. The fluoride-responsive riboswitch can be derived from a naturally-occurring fluoride-responsive riboswitch.

The expression platform domain can be derived from a naturally-occurring riboswitch. In one example, the expression platform domain can be derived from a naturally-occurring fluoride-responsive riboswitch. The expression platform domain can also be heterologous to the fluoride aptamer.

1. Riboswitch

Riboswitches are expression control elements that are part of the RNA molecule to be expressed and that change state when bound by a trigger molecule, such as fluoride. Riboswitches typically can be dissected into two separate domains: one that selectively binds the target (aptamer domain) and another that influences genetic control (expression platform domain). It is the dynamic interplay between these two domains that results in metabolite-dependent allosteric control of gene expression. Disclosed are isolated and recombinant riboswitches, recombinant constructs containing such riboswitches, heterologous sequences operably linked to such riboswitches, and cells and transgenic organisms harboring such riboswitches, riboswitch recombinant constructs, and riboswitches operably linked to heterologous sequences. The heterologous sequences can be, for example, sequences encoding proteins or peptides of interest, including reporter proteins or peptides. Preferred riboswitches are, or are derived from, naturally-occurring riboswitches.

The disclosed riboswitches, including the derivatives and recombinant forms thereof, generally can be from any source, including naturally-occurring riboswitches and riboswitches designed de novo. Any such riboswitches can be used in or with the disclosed methods. However, different types of riboswitches can be defined and some such subtypes can be useful in or with particular methods (generally as described elsewhere herein). Types of riboswitches include, for example, naturally-occurring riboswitches, derivatives and modified forms of naturally-occurring riboswitches, chimeric riboswitches, and recombinant riboswitches. A naturally-occurring riboswitch is a riboswitch having the sequence of a riboswitch as found in nature. Such a naturally-occurring riboswitch can be an isolated or recombinant form of the naturally-occurring riboswitch as it occurs in nature. That is, the riboswitch has the same primary structure but has been isolated or engineered in a new genetic or nucleic acid context. Chimeric riboswitches can be made up of, for example, part of a riboswitch of any or of a particular class or type of riboswitch and part of a different riboswitch of the same or of any different class or type of riboswitch; part of a riboswitch of any or of a particular class or type of riboswitch and any non-riboswitch sequence or component. Recombinant riboswitches are riboswitches that have been isolated or engineered in a new genetic or nucleic acid context.

Different classes of riboswitches refer to riboswitches that have the same or similar trigger molecules or riboswitches that have the same or similar overall structure (predicted, determined, or a combination). Riboswitches of the same class generally, but need not, have both the same or similar trigger molecules and the same or similar overall structure.

Also disclosed are chimeric riboswitches containing heterologous aptamer domains and expression platform domains. That is, chimeric riboswitches are made up of an aptamer domain from one source and an expression platform domain from another source. The heterologous sources can be from, for example, different specific riboswitches, different types of riboswitches, or different classes of riboswitches. The heterologous aptamers can also come from non-riboswitch aptamers. The heterologous expression platform domains can also come from non-riboswitch sources.

Riboswitches can be modified from other known, developed or naturally-occurring riboswitches. For example, switch domain portions can be modified by changing one or more nucleotides while preserving the known or predicted secondary, tertiary, or both secondary and tertiary structure of the riboswitch. For example, both nucleotides in a base pair can be changed to nucleotides that can also base pair. Changes that allow retention of base pairing are referred to herein as base pair conservative changes.

Modified or derivative riboswitches can also be produced using in vitro selection and evolution techniques. In general, in vitro evolution techniques as applied to riboswitches involve producing a set of variant riboswitches where part(s) of the riboswitch sequence is varied while other parts of the riboswitch are held constant. Activation, deactivation or blocking (or other functional or structural criteria) of the set of variant riboswitches can then be assessed and those variant riboswitches meeting the criteria of interest are selected for use or further rounds of evolution. Useful parent riboswitches for generation of variants are the specific and consensus riboswitches disclosed herein. Consensus riboswitches can be used to inform which part(s) of a riboswitch to vary for in vitro selection and evolution. A modified or derivative riboswitch can be a riboswitch that has a least one nucleotide difference from each of the sequences in Table 6. Such a modified or derivative riboswitch can also be considered to be a non-natural riboswitch and to be derived from a naturally occurring riboswitch.

Also disclosed are modified riboswitches with altered regulation. The regulation of a riboswitch can be altered by operably linking an aptamer domain to the expression platform domain of the riboswitch (which is a chimeric riboswitch). The aptamer domain can then mediate regulation of the riboswitch through the action of, for example, a trigger molecule for the aptamer domain. Aptamer domains can be operably linked to expression platform domains of riboswitches in any suitable manner, including, for example, by replacing the normal or natural aptamer domain of the riboswitch with the new aptamer domain. Generally, any compound or condition that can activate, deactivate or block the riboswitch from which the aptamer domain is derived can be used to activate, deactivate or block the chimeric riboswitch.

Also disclosed are inactivated riboswitches. Riboswitches can be inactivated by covalently altering the riboswitch (by, for example, crosslinking parts of the riboswitch or coupling a compound to the riboswitch). Inactivation of a riboswitch in this manner can result from, for example, an alteration that prevents the trigger molecule for the riboswitch from binding, that prevents the change in state of the riboswitch upon binding of the trigger molecule, or that prevents the expression platform domain of the riboswitch from affecting expression upon binding of the trigger molecule.

Also disclosed are biosensor riboswitches. Biosensor riboswitches are engineered riboswitches that produce a detectable signal in the presence of their cognate trigger molecule, such as fluoride. Useful biosensor riboswitches can be triggered at or above threshold levels of the trigger molecules. Biosensor riboswitches can be designed for use in vivo or in vitro. For example, biosensor riboswitches operably linked to a reporter RNA that encodes a protein that serves as or is involved in producing a signal can be used in vivo by engineering a cell or organism to harbor a nucleic acid construct encoding the riboswitch/reporter RNA. An example of a biosensor riboswitch for use in vitro is a riboswitch that includes a conformation dependent label, the signal from which changes depending on the activation state of the riboswitch. Such a biosensor riboswitch preferably uses an aptamer domain from or derived from a naturally-occurring riboswitch. Biosensor riboswitches can be used in various situations and platforms. For example, biosensor riboswitches can be used with solid supports, such as plates, chips, strips and wells.

Also disclosed are modified or derivative riboswitches that recognize new trigger molecules. New riboswitches and/or new aptamers that recognize new trigger molecules can be selected for, designed or derived from known riboswitches. This can be accomplished by, for example, producing a set of aptamer variants in a riboswitch, assessing the activation of the variant riboswitches in the presence of a compound of interest, selecting variant riboswitches that were activated (or, for example, the riboswitches that were the most highly or the most selectively activated), and repeating these steps until a variant riboswitch of a desired activity, specificity, combination of activity and specificity, or other combination of properties results.

Particularly useful aptamer domains can form a stem structure referred to herein as the P1 stem structure (or simply P1). An example of the P1 stem is shown in FIG. 1. The hybridizing strands in the P1 stem structure are referred to as the aptamer strand (also referred to as the P1a strand) and the control strand (also referred to as the P1b strand). The control strand can form a stem structure with both the aptamer strand and a sequence in a linked expression platform that is referred to as the regulated strand (also referred to as the P1c strand). Thus, the control strand (P1b) can form alternative stem structures with the aptamer strand (P1a) and the regulated strand (P1c). Activation and deactivation of a riboswitch results in a shift from one of the stem structures to the other (from P1a/P1b to P1b/P1c or vice versa). The formation of the P1b/P1c stem structure affects expression of the RNA molecule containing the riboswitch. Riboswitches that operate via this control mechanism are referred to herein as alternative stem structure riboswitches (or as alternative stem riboswitches). Activation and deactivation of an aptamer involve similar conformational shifts, although aptamers will not always include nucleic acid to alternatively base pair with the aptamer strand of an aptamer.

In general, any aptamer domain can be adapted for use with any expression platform domain by designing or adapting a regulated strand in the expression platform domain to be complementary to the control strand of the aptamer domain. Alternatively, the sequence of the aptamer and control strands of an aptamer domain can be adapted so that the control strand is complementary to a functionally significant sequence in an expression platform. For example, the control strand can be adapted to be complementary to the Shine-Dalgarno sequence of an RNA such that, upon formation of a stem structure between the control strand and the SD sequence, the SD sequence becomes inaccessible to ribosomes, thus reducing or preventing translation initiation. Note that the aptamer strand would have corresponding changes in sequence to allow formation of a P1 stem in the aptamer domain.

As another example, a transcription terminator can be added to an RNA molecule (most conveniently in an untranslated region of the RNA) where part of the sequence of the transcription terminator is complementary to the control strand of an aptamer domain (the sequence will be the regulated strand). This will allow the control sequence of the aptamer domain to form alternative stem structures with the aptamer strand and the regulated strand, thus either forming or disrupting a transcription terminator stem upon activation or deactivation of the riboswitch. Any other expression element can be brought under the control of a riboswitch by similar design of alternative stem structures.

For transcription terminators controlled by riboswitches, the speed of transcription and spacing of the riboswitch and expression platform elements can be important for proper control. Transcription speed can be adjusted by, for example, including polymerase pausing elements (e.g., a series of uridine residues) to pause transcription and allow the riboswitch to form and sense trigger molecules. For example, with the fluoride-responsive riboswitch, if fluoride is bound to its aptamer domain, then the antiterminator sequence can be sequestered and would be unavailable for formation of an antiterminator structure. However, if fluoride is absent, the antiterminator can form once its nucleotides emerge from the polymerase. RNAP then breaks free of the pause site only to reach another U-stretch and pause again. The transcriptional terminator then forms only if the terminator nucleotides are not tied up by the antiterminator.

Disclosed are regulatable gene expression constructs comprising a nucleic acid molecule encoding an RNA comprising a riboswitch operably linked to a coding region, wherein the riboswitch regulates expression of the RNA, wherein the riboswitch and coding region are heterologous. The riboswitch can comprise an aptamer domain and an expression platform domain, wherein the aptamer domain and the expression platform domain are heterologous. The riboswitch can comprise an aptamer domain and an expression platform domain, wherein the aptamer domain comprises a P1 stem, wherein the P1 stem comprises an aptamer strand and a control strand, wherein the expression platform domain comprises a regulated strand, wherein the regulated strand, the control strand, or both have been designed to form a stem structure.

Disclosed are riboswitches, wherein the riboswitch is a non-natural derivative of a naturally-occurring riboswitch. The riboswitch can comprise an aptamer domain and an expression platform domain, wherein the aptamer domain and the expression platform domain are heterologous. The riboswitch can be derived from a naturally-occurring fluoride-responsive riboswitch. The riboswitch can be activated by a trigger molecule, wherein the riboswitch produces a signal when activated by the trigger molecule.

Numerous riboswitches and riboswitch constructs are described and referred to herein. It is specifically contemplated that any specific riboswitch or riboswitch construct or group of riboswitches or riboswitch constructs can be excluded from some aspects of the invention disclosed herein. For example, fusion of the fluoride-responsive riboswitch with the β-gal reporter gene could be excluded from a set of riboswitches fused to reporter genes.

i. Aptamer Domain

Riboswitches have aptamer domains that, upon binding of a trigger molecule, such as fluoride, result in a change in the state or structure of the riboswitch. In functional riboswitches, the state or structure of the expression platform domain linked to the aptamer domain changes when the trigger molecule binds to the aptamer domain. Aptamer domains of riboswitches can be derived from any source, including, for example, natural aptamer domains of riboswitches, artificial aptamers, engineered, selected, evolved or derived aptamers or aptamer domains. Aptamers in riboswitches generally have at least one portion that can interact, such as by forming a stem structure, with a portion of the linked expression platform domain. This stem structure will either form or be disrupted upon binding of the trigger molecule. Any of the disclosed aptamers can be used in the disclosed riboswitches.

Aptamer domains can also be used for any other purpose, and in any other context, as aptamers.

Fluoride aptamers, their structure, their function, and their locations in genomes are described herein. Many fluoride aptamers are comprised in crcB motifs. crcB motifs, their structure, and their locations in various organisms are described in WO 2011/088076 and Weinberg et al. 2010. Comparative genomics reveals 104 candidate structured RNAs from bacteria, archaeal, and their metagenomes. Genome Biol 11:R31, which are both hereby incorporated by reference in their entirety and specifically for their description of the structure and locations of crcB motifs. In particular, section 24 of Additional File 3 of Weinberg et al., Genome Biol 11:R31 (2010), shows the sequences, genes, organisms, alignments, and consensus structures of numerous crcB motifs, the contents of which is hereby incorporated herein by reference.

ii. Expression Platform Domain

Expression platform domains are a part of riboswitches that affect expression of the RNA molecule that contains the riboswitch. Expression platform domains generally have at least one portion that can interact, such as by forming a stem structure, with a portion of the linked aptamer domain. This stem structure will either form or be disrupted upon binding of the trigger molecule, such as fluoride. The stem structure generally either is, or prevents formation of, an expression regulatory structure. An expression regulatory structure is a structure that allows, prevents, enhances or inhibits expression of an RNA molecule containing the structure. Examples include Shine-Dalgarno sequences, initiation codons, transcription terminators, and stability and processing signals, such as splice sites and sequences.

C. Fluoride-Regulated Expression Constructs

Fluoride-regulated expression constructs are expression constructs the expression of which is regulated by fluoride. For example, an expression construct containing a fluoride-responsive riboswitch can be regulated by fluoride. The constructs can include, for example, a nucleic acid molecule encoding one or more of the disclosed fluoride aptamer nucleic acid molecules. In some forms, the fluoride-responsive riboswitch can be operably linked to a coding region, whereby expression of the coding region can be regulated by the riboswitch. In some forms, the riboswitch and coding region can be heterologous. In some forms, the riboswitch and coding region can be heterologous to each other. In some forms, expression of the coding region can produce a signal. In some forms, expression of the coding region can induce or cause death of the cell in which it is expressed. In some forms, expression of the coding region can induce or cause stasis of the cell in which it is expressed. Expression constructs are nucleic acid molecules that are capable of being expressed. Generally, expression constructs will include sequences or components that facilitate or promote expression and sequences or components that are expressed and/or that produce an expression product. Expression products are components or molecules, such as RNA and proteins, that are produced when a gene or other expression construct is expressed. Coding regions refer to regions of nucleic acid molecules, such as transcripts, genes, chromosomes, etc., that encode amino acids. Generally, a coding region will contain an open reading frame.

D. Fluoride Transporters

Disclosed are fluoride transporters. Fluoride transporters are membrane proteins that facilitate passage of fluoride ions through the membrane. Fluoride transporters have been discovered in, for example, a variety of bacteria, archae, and fungi. Fluoride transporters can be used, for example, to increase the fluoride tolerance of a cell or as a target for inhibitors that can increase the level of fluoride in a cell. The fluoride transporters can be a bacterial fluoride transporter, an archaeal fluoride transporter or a eukaryotic fluoride transporter. The eukaryotic fluoride transporters can be, but are not limited to, a fungal fluoride transporter, a plant fluoride transporter, or other eukaryotic species transporter.

As used herein, "transporter" refers to a protein that facilitates passage of compounds or molecules through a lipid membrane. For example, transporters can facilitate passage of compounds and molecules through cell membranes. Transporters can be indiscriminate or non-selective or transporters can be fastidious or selective. That is, non-selective transporters can facilitate passage of a range of compounds or molecules—a particular class of compound or molecule, for example—and selective transporters can selectively facilitate only one compound or molecule or type of compound or molecule—a single compound, for example. The disclosed fluoride transporters generally are selective transporters that do not significantly facilitate passage of ions, elements, or compounds other than fluoride. Transporters can facilitate passage of by a variety of mechanisms, such as passive transport, active transport, pumping, etc. Transporters can be referred to with various terms, such as pumps, channels, gates, pores, etc., some of which are meant to indicate their mechanism. A native fluoride transporter refers to a fluoride transporter that naturally occurs in a cell, tissue, organ, organism, microorganism, etc.

Fluoride transporters have been identified as a subset of proteins associated with chloride transporters. For example, some fluoride transporters are encoded by $eriC^F$ genes and others by crcB genes. The protein sequence of EriC fluoride transporters were aligned to one another. The alignment included both proteins whose expression are regulated by a fluoride riboswitch as well as proteins that are not know to be regulated by a riboswitch. Proteins within version 44 of the RefSeq nucleotide database were used to form the alignment. The resulting multiple-sequence alignment defines the features of EriC proteins that function as fluoride channels. CrcB proteins can function as fluoride transporters or channels. To classify proteins as CrcB, the Pfam database (at internet site pfam.sanger.ac.uk) protein family with accession PF02537 was used in version 24.0 of the database. The Pfam database defines a protocol and parameters for determining whether a protein belongs to the CrcB class. Characteristics and methods of identification of fluoride transporters are also described in the Examples. Table 6 lists the sequences and alignments of examples of fluoride transporters identified as described above.

The fluoride transporter can be derived from a gene that is regulated by a fluoride-responsive riboswitch. The fluoride transporter can also be derived from a gene that is regulated by a riboswitch, wherein the riboswitch can include a crcB motif.

Expression constructs that encodes a fluoride transporter are provided. Also provided are cells that can include the disclosed expression constructs and wherein the fluoride transporter can be heterologous to the cell. The cells can be recombinant. The expression construct in the disclosed cells can include a fluoride-responsive riboswitch. The fluoride-responsive riboswitch can be operably linked to a coding region, and expression of the coding region can be regulated by the riboswitch. In one embodiment, the coding region can encode the fluoride transporter.

Compounds that inhibit a fluoride transporter are provided. In some forms, the compound can have the structure

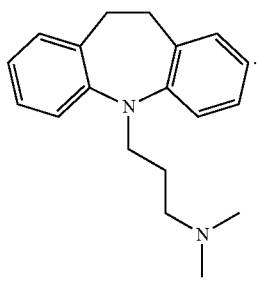 [SMILES: CN(C)CCCN1c2ccccc2CCc2ccccc21]

E. Cells

Disclosed are cells containing, including, expressing, etc. the disclosed fluoride aptamers, fluoride-responsive riboswitches, fluoride-regulated expression constructs, and/or fluoride transporters. For example, cells comprising any of the fluoride-regulated expression constructs disclosed herein are provided. The expression of the coding region can be regulated by fluoride. The expression of the coding region can produce a signal and the signal can indicate the presence of fluoride in the cell. The coding region can encode an expression product, wherein production of the expression product by the cell can be regulated by fluoride. Expression of the coding region can induce or cause death of the cell. Expression of the coding region can also induce or cause stasis of the cell. Also disclosed are cells including any one of the fluoride aptamer nucleic acid molecules disclosed herein. The cells can overexpress the coding region and therefore can be useful in bioproduction. Also disclosed are cells comprising one or more of the disclosed fluoride aptamer nucleic acid molecules. Additional cells are described elsewhere herein.

In some forms, the cell can comprise a fluoride-sensing element. A fluoride-sensing element is any of the disclosed components that can bind, detect, sense, etc. fluoride. Generally, a fluoride sensing element will signal, indicate, react, etc. when fluoride is bound, detected, sensed, etc. In some forms, the fluoride-sensing element can comprise a fluoride-regulated expression construct comprising a nucleic acid molecule encoding a fluoride-responsive riboswitch operably linked to a coding region, where expression of the coding region is regulated by the riboswitch, where expression of the coding region produces a signal, where the signal indicates the presence of fluoride in the cell. In some forms, the fluoride-sensing element can comprise a fluoride aptamer operably linked to a signal-generating component, where the signal-generating component generates a signal when the fluoride aptamer is bound by fluoride, where the signal indicates the presence of fluoride in the cell. In some forms, the cell can lack a native fluoride transporter. In some forms, the cell can comprise a heterologous fluoride transporter.

F. Compounds and Compositions that Enhance Fluoride Toxicity

Disclosed are compounds and compositions that enhance fluoride toxicity. In some forms, the composition can comprise one or more of the disclosed compounds. In some forms, the compound can be a compound identified by any one of the disclosed methods for identifying compounds that increases fluoride concentration in a cell, by any one of the disclosed methods for identifying compounds that that affect expression of fluoride-responsive riboswitches, or both.

By enhancing fluoride toxicity is meant that fluoride that is present at a given concentration, level, amount, etc. of fluoride is made more toxic to cells that are present. Generally, this will involve increasing the concentration, level, amount, etc. of fluoride in the cells beyond what the concentration, level, amount, etc. would have been in the absence of the compounds, components, steps, methods, etc. used to enhance fluoride toxicity. The disclosed methods of enhancing fluoride toxicity generally involve increasing the fluoride concentration or level in particular cells, such as microbial cells, by inhibiting or disabling the cells' fluoride mitigation components and systems. Because of this, fluoride toxicity can be directed to certain cells and organisms, such as microbes, without significantly affecting other organisms. For example, bacteria in a host organism, such as a human or other mammal, can be affected by the disclosed methods, enhancing fluoride toxicity in the bacteria without significantly affecting the host organism. The disclosed methods can also result in making moderate levels of fluoride more effective and allowing use of lower amounts and concentrations of fluoride to achieve antimicrobial results.

In some forms, the composition can comprise a compound that inhibits a fluoride transporter. In some forms, the compound has the structure

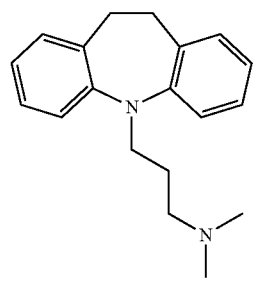 [SMILES: CN(C)CCCN1c2ccccc2CCc2ccccc21]

3-(10,11-dihydro-5H-dibenzo[b,f]azepin-5-yl)-N,N-dimethylpropan-1-amine

In some forms, the composition can comprise a compound that inhibits activation of a fluoride-responsive riboswitch. Such compounds can render cells more sensitive to fluoride by, for example, reducing production of fluoride transporters and/or other genes that mitigate the effect of fluoride in a cell. As an example, the compound can comprise a nucleic acid molecule that binds to and interferes with function of a fluoride-responsive riboswitch. For example, a nucleic acid molecule, such as a peptide nucleic acid, complementary to the aptamer strand, control strand, or regulated strand and be used to interfere with the function of a riboswitch. The sequence in an aptamer or riboswitch to which the nucleic acid molecule is complementary can be referred to as a target sequence. Nucleic acid molecules for interfering with the function of riboswitches can also include sequences complementary sequences adjacent to stem-forming sequences in an aptamer or riboswitch. This can make the nucleic acid molecule more effective in hybridizing to the aptamer or riboswitch. Antisense and other interfering nucleic acids operate in bacterial and other microorganisms as well as in eukaryotes and many forms and designs of such nucleic acids are known. Such antisense and interfering nucleic acids can be used in the disclosed methods to affect riboswitches and the expression of fluoride transporters and other riboswitch-regulated genes and expression constructs.

In some forms, the composition can comprise a compound that increases permeability of a cell membrane to fluoride. In some forms, the composition can comprise a compound that binds to fluoride and that facilitates passage of fluoride through a cell membrane to fluoride. In some forms, the compound has the structure

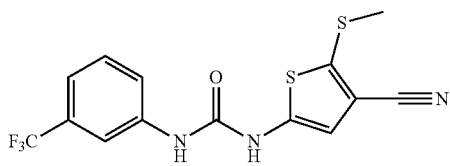 [SMILES: CSc1sc(NC(=O)Nc2cccc(C(F)(F)F)c2)cc1C#N]

1-(4-cyano-5-(methylthio)thiophen-2-yl)-3-(3-(trifluoromethyl)phenyl)urea

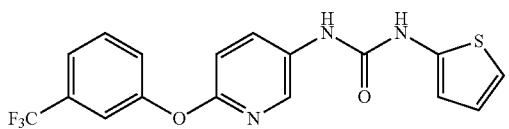 [SMILES: O=C(Nc1ccc(Oc2cccc(C(F)(F)F)c2)nc1)Nc1cccs1]

1-(thiophen-2-yl)-3-(6-(3-(trifluoromethyl)phenoxy)pyridin-3-yl)urea

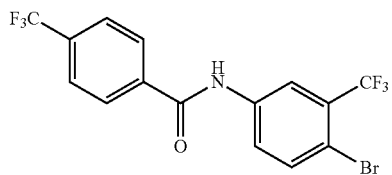 [SMILES: O=C(Nc1ccc(Br)c(C(F)(F)F)c1)c1ccc(C(F)(F)F)cc1]

N-(4-bromo-3-(trifluoromethyl)phenyl)-4-(trifluoromethyl)benzamide

As described elsewhere herein, the disclosed compounds and compositions can be used to control cells, kill cells, inhibit growth of cells, etc. by enhancing the effect of fluoride on the cells. The disclosed compounds and compositions can be included in, composed in, combined with, etc. compositions, products, objects, foods, substances, etc. Doing so can inhibit the growth and/or effect of cells on the compositions, products, objects, foods, substances, etc. by, for example, increasing the sensitivity of the cells to fluoride. Thus, fluoride can also be included in such compositions, products, objects, foods, substances, etc.

In some forms, the composition can further comprise a carrier. In some forms, the carrier can comprise a cream, paste, fluid, coating, paint, spray, detergent, or a combination. In some forms, the composition can further comprise an antimicrobial agent. In some forms, the composition can further comprise a bioavailable form of fluoride. In some forms, the carrier can comprise antimicrobial cream, antimicrobial paste, antimicrobial fluid, antimicrobial coating, antimicrobial paint, antimicrobial spray, antimicrobial detergent, antimicrobial soap, mouthwash, skinwash, nasal wash, toothpaste, toothwash, dish detergent, laundry detergent, dishwasher detergent, nasal spray, mouth spray, throat spray, skin spray, douche fluid, enema fluid, wound cleanser, wound covering, eyewash, shampoo, facial wash, facial cream, or facial soap. In some forms, the composition can be an additive for addition to food or a product. In some forms, the composition can be included in building materials. In some forms, the composition can be included in household objects and surfaces. The disclosed compounds and compositions can be included in any compositions, products, objects, foods, substances, etc.

Also disclosed are objects and substances comprising one or more of the disclosed compositions. In some forms, the composition can increase preservation of the object or substance. In some forms, the composition can reduce microbes on or in proximity to the object or substance.

G. Constructs, Vectors and Expression Systems

The disclosed riboswitches, aptamers, and fluoride transporter genes can be used in any suitable expression system. Recombinant expression is usefully accomplished using a vector, such as a plasmid. The vector can include a promoter operably linked to riboswitch-encoding sequence and RNA to be expression (e.g., RNA encoding a protein). The vector can also include other elements required for transcription and translation. As used herein, vector refers to any carrier containing exogenous DNA. Thus, vectors are agents that transport the exogenous nucleic acid into a cell without degradation and include a promoter yielding expression of the nucleic acid in the cells into which it is delivered. Vectors include but are not limited to plasmids, viral nucleic acids, viruses, phage nucleic acids, phages, cosmids, and artificial chromosomes. A variety of prokaryotic and eukaryotic expression vectors suitable for carrying riboswitch-regulated constructs can be produced. Such expression vectors include, for example, pET, pET3d, pCR2.1, pBAD, pUC, and yeast vectors. The vectors can be used, for example, in a variety of in vivo and in vitro situation.

Viral vectors include adenovirus, adeno-associated virus, herpes virus, vaccinia virus, polio virus, AIDS virus, neuronal trophic virus, Sindbis and other RNA viruses, including these viruses with the HIV backbone. Also useful are any viral families which share the properties of these viruses which make them suitable for use as vectors. Retroviral vectors, which are described in Verma (1985), include Murine Maloney Leukemia virus, MMLV, and retroviruses that express the desirable properties of MMLV as a vector. Typically, viral vectors contain, nonstructural early genes, structural late genes, an RNA polymerase III transcript, inverted terminal repeats necessary for replication and encapsidation, and promoters to control the transcription and replication of the viral genome. When engineered as vectors, viruses typically have one or more of the early genes removed and a gene or gene/promotor cassette is inserted into the viral genome in place of the removed viral DNA.

A "promoter" is generally a sequence or sequences of DNA that function when in a relatively fixed location in regard to the transcription start site. A "promoter" contains core elements required for basic interaction of RNA polymerase and transcription factors and can contain upstream elements and response elements.

"Enhancer" generally refers to a sequence of DNA that functions at no fixed distance from the transcription start site and can be either 5' (Laimins, 1981) or 3' (Lusky et al., 1983) to the transcription unit. Furthermore, enhancers can be within an intron (Banerji et al., 1983) as well as within the coding sequence itself (Osborne et al., 1984). They are usually between 10 and 300 bp in length, and they function in cis. Enhancers function to increase transcription from nearby promoters. Enhancers, like promoters, also often contain response elements that mediate the regulation of transcription. Enhancers often determine the regulation of expression.

Expression vectors used in eukaryotic host cells (yeast, fungi, insect, plant, animal, human or nucleated cells) can also contain sequences necessary for the termination of transcription which can affect mRNA expression. These regions are transcribed as polyadenylated segments in the untranslated portion of the mRNA encoding tissue factor protein. The 3' untranslated regions also include transcription termination sites. It is preferred that the transcription unit also contains a polyadenylation region. One benefit of this region is that it increases the likelihood that the transcribed unit will be processed and transported like mRNA. The identification and use of polyadenylation signals in expression constructs is well established. It is preferred that homologous polyadenylation signals be used in the transgene constructs.

The vector can include nucleic acid sequence encoding a marker product. This marker product is used to determine if the gene has been delivered to the cell and once delivered to the cell is being expressed. Preferred marker genes are the E. coli lacZ gene which encodes β-galactosidase and green fluorescent protein.

In some embodiments the marker can be a selectable marker. When such selectable markers are successfully transferred into a host cell, the transformed host cell can survive if placed under selective pressure. There are two widely used distinct categories of selective regimes. The first category is based on a cell's metabolism and the use of a mutant cell line which lacks the ability to grow independent of a supplemented media. The second category is dominant selection which refers to a selection scheme used in any cell type and does not require the use of a mutant cell line. These schemes typically use a drug to arrest growth of a host cell. Those cells which have a novel gene would express a protein conveying drug resistance and would survive the selection. Examples of such dominant selection use the drugs neomycin, (Southern and Berg, 1982), mycophenolic acid, (Mulligan and Berg, 1980) or hygromycin (Sugden et al., 1985).

Gene transfer can be obtained using direct transfer of genetic material, in but not limited to, plasmids, viral vectors, viral nucleic acids, phage nucleic acids, phages, cosmids, and artificial chromosomes, or via transfer of genetic material in cells or carriers such as cationic liposomes. Such methods are well known in the art and readily adaptable for use in the method described herein. Transfer vectors can be any nucleotide construction used to deliver genes into cells (e.g., a plasmid), or as part of a general strategy to deliver genes, e.g., as part of recombinant retrovirus or adenovirus (Ram et al. Cancer Res. 53:83-88, (1993)). Appropriate means for transfection, including viral vectors, chemical transfectants, or physico-mechanical methods such as electroporation and direct diffusion of DNA, are described by, for example, Wolff, J. A., et al., Science, 247, 1465-1468, (1990); and Wolff, J. A. Nature, 352, 815-818, (1991).

1. Viral Promoters and Enhancers

Preferred promoters controlling transcription from vectors in mammalian host cells can be obtained from various sources, for example, the genomes of viruses such as: polyoma, Simian Virus 40 (SV40), adenovirus, retroviruses, hepatitis-B virus and most preferably cytomegalovirus, or from heterologous mammalian promoters, e.g. beta actin promoter. The early and late promoters of the SV40 virus are conveniently obtained as an SV40 restriction fragment which also contains the SV40 viral origin of replication (Fiers et al., Nature, 273: 113 (1978)). The immediate early promoter of the human cytomegalovirus is conveniently obtained as a HindIII E restriction fragment (Greenway, P. J. et al., Gene 18: 355-360 (1982)). Of course, promoters from the host cell or related species also are useful herein.

Enhancer generally refers to a sequence of DNA that functions at no fixed distance from the transcription start site and can be either 5' (Laimins, L. et al., Proc. Natl. Acad. Sci. 78: 993 (1981)) or 3' (Lusky, M. L., et al., Mol. Cell Bio. 3: 1108 (1983)) to the transcription unit. Furthermore, enhancers can be within an intron (Banerji, J. L. et al., Cell 33: 729 (1983)) as well as within the coding sequence itself (Osborne, T. F., et al., Mol. Cell Bio. 4: 1293 (1984)). They are usually between 10 and 300 bp in length, and they function in cis. Enhancers function to increase transcription from nearby promoters. Enhancers also often contain response elements that mediate the regulation of transcription. Promoters can also contain response elements that mediate the regulation of transcription. Enhancers often determine the regulation of expression of a gene. While many enhancer sequences are now known from mammalian genes (globin, elastase, albumin, α-fetoprotein and insulin), typically one will use an enhancer from a eukaryotic cell virus. Preferred examples are the SV40 enhancer on the late side of the replication origin (bp 100-270), the cytomegalovirus early promoter enhancer, the polyoma enhancer on the late side of the replication origin, and adenovirus enhancers.

The promotor and/or enhancer can be specifically activated either by light or specific chemical events which trigger their function. Systems can be regulated by reagents such as tetracycline and dexamethasone. There are also ways to enhance viral vector gene expression by exposure to irradiation, such as gamma irradiation, or alkylating chemotherapy drugs.

It is preferred that the promoter and/or enhancer region be active in all eukaryotic cell types. A preferred promoter of this type is the CMV promoter (650 bases). Other preferred promoters are SV40 promoters, cytomegalovirus (full length promoter), and retroviral vector LTF.

It has been shown that all specific regulatory elements can be cloned and used to construct expression vectors that are selectively expressed in specific cell types such as melanoma cells. The glial fibrillary acetic protein (GFAP) promoter has been used to selectively express genes in cells of glial origin.

Expression vectors used in eukaryotic host cells (yeast, fungi, insect, plant, animal, human or nucleated cells) can also contain sequences necessary for the termination of transcription which can affect mRNA expression. These regions are transcribed as polyadenylated segments in the untranslated portion of the mRNA encoding tissue factor protein. The 3' untranslated regions also include transcription termination sites. It is preferred that the transcription unit also contains a polyadenylation region. One benefit of this region is that it increases the likelihood that the transcribed unit will be processed and transported like mRNA. The identification and use of polyadenylation signals in expression constructs is well established. It is preferred that homologous polyadenylation signals be used in the transgene constructs. In a preferred embodiment of the transcription unit, the polyadenylation region is derived from the SV40 early polyadenylation signal and consists of about 400 bases. It is also preferred that the transcribed units contain other standard sequences alone or in combination with the above sequences improve expression from, or stability of, the construct.

2. Markers

The vectors can include nucleic acid sequence encoding a marker product. This marker product can be used to determine if the gene has been delivered to the cell and once delivered is being expressed. Preferred marker genes are the *E. coli* lacZ gene which encodes β-galactosidase and green fluorescent protein.

In some embodiments the marker can be a selectable marker. Examples of suitable selectable markers for mammalian cells are dihydrofolate reductase (DHFR), thymidine kinase, neomycin, neomycin analog G418, hydromycin, and puromycin. When such selectable markers are successfully transferred into a mammalian host cell, the transformed mammalian host cell can survive if placed under selective pressure. There are two widely used distinct categories of selective regimes. The first category is based on a cell's metabolism and the use of a mutant cell line which lacks the ability to grow independent of a supplemented media. Two examples are: CHO DHFR$^-$ cells and mouse LTK$^-$ cells. These cells lack the ability to grow without the addition of such nutrients as thymidine or hypoxanthine. Because these cells lack certain genes necessary for a complete nucleotide synthesis pathway, they cannot survive unless the missing nucleotides are provided in a supplemented media. An alternative to supplementing the media is to introduce an intact DHFR or TK gene into cells lacking the respective genes, thus altering their growth requirements. Individual cells which were not transformed with the DHFR or TK gene will not be capable of survival in non-supplemented media.

The second category is dominant selection which refers to a selection scheme used in any cell type and does not require the use of a mutant cell line. These schemes typically use a drug to arrest growth of a host cell. Those cells which would express a protein conveying drug resistance would survive the selection. Examples of such dominant selection use the drugs neomycin, (Southern P. and Berg, P., J. Molec. Appl. Genet. 1: 327 (1982)), mycophenolic acid, (Mulligan, R. C. and Berg, P. Science 209: 1422 (1980)) or hygromycin, (Sugden, B. et al., Mol. Cell. Biol. 5: 410-413 (1985)). The three examples employ bacterial genes under eukaryotic control to convey resistance to the appropriate drug G418 or neomycin (geneticin), xgpt (mycophenolic acid) or hygromycin, respectively. Others include the neomycin analog G418 and puramycin.

H. Sequestration Tags

Sequestration tags are moieties, molecules, or another component that can facilitate separation of the sequestration tag from a mixture. For example, sequestration tags can be flags or one partner of a binding pair such that the flag-binding molecule or binding partner of the sequestration tag binds the sequestration tag. If the flag-binding molecule or binding partner of the sequestration tag is immobilized, for example, the sequestration tag can become immobilized through binding. As another example, the sequestration tag can be recognized by a specific binding molecule, such as an antibody. As another example, the sequestration tag can have a property that facilitates separation. For example, a magnetic tag can be used to hold or remove components form a mixture. Myriad examples of these and other forms of binding and separation tags are known and can be used for and with the disclosed sequestration tags.

By "partner of a binding pair" is meant one of a first and a second moiety, wherein said first and said second moiety have a specific binding affinity for each other. For binding pairs, one can be used as a sequestration tag and the other can be used as the binding agent for the sequestration tag. Suitable binding pairs for use in the method include, but are not limited to, antigens/antibodies (for example, digoxigenin/anti-digoxigenin, dinitrophenyl (DNP)/anti-DNP, dansyl-X-anti-dansyl, Fluorescein/anti-fluorescein, lucifer yellow/anti-lucifer yellow, and rhodamine anti-rhodamine), biotin/avid (or biotin/streptavidin) and calmodulin binding protein (CBP)/calmodulin. Other suitable binding pairs include polypeptides such as the FLAG-peptide (Hopp et al., BioTechnology, 6:1204-1210 (1988)); the KT3 epitope peptide (Martin et al., Science, 255:192-194 (1992)); tubulin epitope peptide (Skinner et al., J. Biol. Chem., 266:15163-15166 (1991)); and the T7 gene 10 protein peptide tag (Lutz-Freyermuth et al., Proc. Natl. Acad. Sci. USA, 87:6393-6397 (1990)) and the antibodies each thereto. Generally, in some aspects, the smaller of the binding pair partners serves as the sequestration tag.

As will be appreciated by those in the art, a partner of one binding pair can also be a partner of another binding pair. For example, an antigen (first moiety) can bind to a first antibody (second moiety) which can, in turn, be an antigen for a second antibody (third moiety). It will be further appreciated that such a circumstance allows indirect binding of a first moiety and a third moiety via an intermediary second moiety that is a binding pair partner to each.

I. Signal-Generating Components

Signal-generating components are components that generate a detectable signal upon an event. For example, a signal-generating component when operably linked to a fluoride aptamer can generate a signal when the aptamer binds fluoride. As another example, a signal-generating component operably linked to a fluoride-responsive riboswitch can generate a signal when the aptamer binds fluoride. For example, a reporter gene or RNA that encodes a protein that serves as or is involved in producing a signal can be used as a signal-generating component. A conformation dependent label, the signal from which changes depending on the conformation of the milieu of the label, can be used as a signal-generating component. For example, a fluoride aptamer or fluoride-responsive riboswitch can include a conformation dependent label, the signal as a signal-generating component. The label's signal changes depending on the activation state of the aptamer or riboswitch.

1. Reporter Proteins and Peptides

A reporter protein or peptide can be used as a signal-generating component. The reporter protein or peptide can be encoded by the RNA the expression of which is regulated by the riboswitch. The examples describe the use of some specific reporter proteins. The use of reporter proteins and peptides is well known and can be adapted easily for use with riboswitches. The reporter proteins can be any protein or peptide that can be detected or that produces a detectable signal. Preferably, the presence of the protein or peptide can be detected using standard techniques (e.g., radioimmunoassay, radio-labeling, immunoassay, assay for enzymatic activity, absorbance, fluorescence, luminescence, and Western blot). More preferably, the level of the reporter protein is easily quantifiable using standard techniques even at low levels. Useful reporter proteins include luciferases, green fluorescent proteins and their derivatives, such as firefly luciferase (FL) from *Photinus pyralis*, and *Renilla luciferase* (RL) from *Renilla reniformis*.

2. Conformation Dependent Labels

Conformation dependent labels refer to all labels that produce a change in fluorescence intensity or wavelength based on a change in the form or conformation of the molecule or compound (such as a riboswitch) with which the label is associated. Examples of conformation dependent labels used in the context of probes and primers include molecular beacons, Amplifluors, FRET probes, cleavable FRET probes, TaqMan probes, scorpion primers, fluorescent triplex oligos including but not limited to triplex molecular beacons or triplex FRET probes, fluorescent water-soluble conjugated polymers, PNA probes and QPNA probes. Such labels, and, in particular, the principles of their function, can be adapted for use with riboswitches. Several types of conformation dependent labels are reviewed in Schweitzer and Kingsmore, Curr. Opin. Biotech. 12:21-27 (2001).

Stem quenched labels, a form of conformation dependent labels, are fluorescent labels positioned on a nucleic acid such that when a stem structure forms a quenching moiety is brought into proximity such that fluorescence from the label is quenched. When the stem is disrupted (such as when an aptamer or riboswitch containing the label is activated), the quenching moiety is no longer in proximity to the fluorescent label and fluorescence increases. Examples of this effect can be found in molecular beacons, fluorescent triplex oligos, triplex molecular beacons, triplex FRET probes, and QPNA probes, the operational principles of which can be adapted for use with aptamers and riboswitches.

Stem activated labels, a form of conformation dependent labels, are labels or pairs of labels where fluorescence is increased or altered by formation of a stem structure. Stem activated labels can include an acceptor fluorescent label and a donor moiety such that, when the acceptor and donor are in proximity (when the nucleic acid strands containing the labels form a stem structure), fluorescence resonance energy transfer from the donor to the acceptor causes the acceptor to fluoresce. Stem activated labels are typically pairs of labels positioned on nucleic acid molecules (such as riboswitches) such that the acceptor and donor are brought into proximity when a stem structure is formed in the nucleic acid molecule. If the donor moiety of a stem activated label is itself a fluorescent label, it can release energy as fluorescence (typically at a different wavelength than the fluorescence of the acceptor) when not in proximity to an acceptor (that is, when a stem structure is not formed). When the stem structure forms, the overall effect would then be a reduction of donor fluorescence and an increase in acceptor fluorescence. FRET probes are an example of the use of stem activated labels, the operational principles of which can be adapted for use with aptamers and riboswitches.

3. Detection Labels

To aid in detection and quantitation of aptamer and riboswitch activation, deactivation or blocking, or expression of nucleic acids or protein produced upon activation, deactivation or blocking of riboswitches, detection labels can be incorporated into detection probes or detection molecules or directly incorporated into expressed nucleic acids or proteins. As used herein, a detection label is any molecule that can be associated with nucleic acid or protein, directly or indirectly, and which results in a measurable, detectable signal, either directly or indirectly. Many such labels are known to those of skill in the art. Examples of detection labels suitable for use in the disclosed method are radioactive isotopes, fluorescent molecules, phosphorescent molecules, enzymes, antibodies, and ligands.

Examples of suitable fluorescent labels include fluorescein isothiocyanate (FITC), 5,6-carboxymethyl fluorescein, Texas red, nitrobenz-2-oxa-1,3-diazol-4-yl (NBD), coumarin, dansyl chloride, rhodamine, amino-methyl coumarin (AMCA), Eosin, Erythrosin, BODIPY®, Cascade Blue®, Oregon Green®, pyrene, lissamine, xanthenes, acridines, oxazines, phycoerythrin, macrocyclic chelates of lanthanide ions such as quantum Dye™, fluorescent energy transfer dyes, such as thiazole orange-ethidium heterodimer, and the cyanine dyes Cy3, Cy3.5, Cy5, Cy5.5 and Cy7. Examples of other specific fluorescent labels include 3-Hydroxypyrene 5,8,10-Tri Sulfonic acid, 5-Hydroxy Tryptamine (5-HT), Acid Fuchsin, Alizarin Complexon, Alizarin Red, Allophycocyanin, Aminocoumarin, Anthroyl Stearate, Astrazon Brilliant Red 4G, Astrazon Orange R, Astrazon Red 6B, Astrazon Yellow 7 GLL, Atabrine, Auramine, Aurophosphine, Aurophosphine G, BAO 9 (Bisaminophenyloxadiazole), BCECF, Berberine Sulphate, Bisbenzamide, Blancophor FFG Solution, Blancophor SV, Bodipy F1, Brilliant Sulphoflavin FF, Calcien Blue, Calcium Green, Calcofluor RW Solution, Calcofluor White, Calcophor White ABT Solution, Calcophor White Standard Solution, Carbostyryl, Cascade Yellow, Catecholamine, Chinacrine, Coriphosphine O, Coumarin-Phalloidin, CY3.1 8, CY5.1 8, CY7, Dans (1-Dimethyl Amino Naphaline 5 Sulphonic Acid), Dansa (Diamino Naphtyl Sulphonic Acid), Dansyl NH-CH3, Diamino Phenyl Oxydiazole (DAO), Dimethylamino-5-Sulphonic acid, Dipyrrometheneboron Difluoride, Diphenyl Brilliant Flavine 7GFF, Dopamine, Erythrosin ITC, Euchrysin, FIF (Formaldehyde Induced Fluorescence), Flazo Orange, Fluo 3, Fluorescamine, Fura-2, Genacryl Brilliant Red B, Genacryl Brilliant Yellow 10GF, Genacryl Pink 3G, Genacryl Yellow 5GF, Gloxalic Acid, Granular Blue, Haematoporphyrin, Indo-1, Intrawhite Cf Liquid, Leucophor PAF, Leucophor SF, Leucophor WS, Lissamine Rhodamine B200 (RD200), Lucifer Yellow CH, Lucifer Yellow VS, Magdala Red, Marina Blue, Maxilon Brilliant Flavin 10 GFF, Maxilon Brilliant Flavin 8 GFF, MPS (Methyl Green Pyronine Stilbene), Mithramycin, NBD Amine, Nitrobenzoxadidole, Noradrenaline, Nuclear Fast Red, Nuclear Yellow, Nylosan Brilliant Flavin E8G, Oxadiazole, Pacific Blue, Pararosaniline (Feulgen), Phorwite AR Solution, Phorwite BKL, Phorwite Rev, Phorwite RPA, Phosphine 3R, Phthalocyanine, Phycoerythrin R, Polyazaindacene Pontochrome Blue Black, Porphyrin, Primuline, Procion Yellow, Pyronine, Pyronine B, Pyrozal Brilliant Flavin 7GF, Quinacrine Mustard, Rhodamine 123, Rhodamine 5 GLD, Rhodamine 6G, Rhodamine B, Rhodamine B 200, Rhodamine B Extra, Rhodamine BB, Rhodamine BG, Rhodamine WT, Serotonin, Sevron Brilliant Red 2B, Sevron Brilliant Red 4G, Sevron Brilliant Red B, Sevron Orange, Sevron Yellow L, SITS (Primuline), SITS (Stilbene Isothiosulphonic acid), Stilbene, Snarf 1, sulpho Rhodamine B Can C, Sulpho Rhodamine G Extra, Tetracycline, Thiazine Red R, Thioflavin S, Thioflavin TCN, Thioflavin 5, Thiolyte, Thiozol Orange, Tinopol CBS, True Blue, Ultralite, Uranine B, Uvitex SFC, Xylene Orange, and XRITC.

Useful fluorescent labels are fluorescein (5-carboxyfluorescein-N-hydroxysuccinimide ester), rhodamine (5,6-tetramethyl rhodamine), and the cyanine dyes Cy3, Cy3.5, Cy5, Cy5.5 and Cy7. The absorption and emission maxima, respectively, for these fluors are: FITC (490 nm; 520 nm), Cy3 (554 nm; 568 nm), Cy3.5 (581 nm; 588 nm), Cy5 (652 nm: 672 nm), Cy5.5 (682 nm; 703 nm) and Cy7 (755 nm; 778 nm), thus allowing their simultaneous detection. Other examples of fluorescein dyes include 6-carboxyfluorescein (6-FAM), 2',4',1,4,-tetrachlorofluorescein (TET), 2',4',5',7', 1,4-hexachlorofluorescein (HEX), 2',7'-dimethoxy-4',5'-dichloro-6-carboxyrhodamine (JOE), 2'-chloro-5'-fluoro-7',8'-fused phenyl-1,4-dichloro-6-carboxyfluorescein (NED), and 2'-chloro-7'-phenyl-1,4-dichloro-6-carboxyfluorescein (VIC). Fluorescent labels can be obtained from a variety of commercial sources, including Amersham Pharmacia Biotech, Piscataway, N.J.; Molecular Probes, Eugene, Oreg.; and Research Organics, Cleveland, Ohio.

Additional labels of interest include those that provide for signal only when the probe with which they are associated is specifically bound to a target molecule, where such labels include: "molecular beacons" as described in Tyagi & Kramer, Nature Biotechnology (1996) 14:303 and EP 0 070 685 B1. Other labels of interest include those described in U.S. Pat. No. 5,563,037; WO 97/17471 and WO 97/17076.

Labeled nucleotides are a useful form of detection label for direct incorporation into expressed nucleic acids during synthesis. Examples of detection labels that can be incorporated into nucleic acids include nucleotide analogs such as BrdUrd (5-bromodeoxyuridine, Hoy and Schimke, *Mutation Research* 290:217-230 (1993)), aminoallyldeoxyuridine (Henegariu et al., *Nature Biotechnology* 18:345-348 (2000)), 5-methylcytosine (Sano et al., *Biochim. Biophys. Acta* 951:157-165 (1988)), bromouridine (Wansick et al., *J. Cell Biology* 122:283-293 (1993)) and nucleotides modified with biotin (Langer et al., *Proc. Natl. Acad. Sci. USA* 78:6633 (1981)) or with suitable haptens such as digoxygenin (Kerkhof, *Anal. Biochem.* 205:359-364 (1992)). Suitable fluorescence-labeled nucleotides are Fluorescein-isothiocyanate-dUTP, Cyanine-3-dUTP and Cyanine-5-dUTP (Yu et al., *Nucleic Acids Res.,* 22:3226-3232 (1994)). A preferred nucleotide analog detection label for DNA is BrdUrd (bromodeoxyuridine, BrdUrd, BrdU, BUdR, Sigma-Aldrich Co). Other useful nucleotide analogs for incorporation of detection label into DNA are AA-dUTP (aminoallyl-deoxyuridine triphosphate, Sigma-Aldrich Co.), and 5-methyl-dCTP (Roche Molecular Biochemicals). A useful nucleotide analog for incorporation of detection label into RNA is biotin-16-UTP (biotin-16-uridine-5'-triphosphate, Roche Molecular Biochemicals). Fluorescein, Cy3, and Cy5 can be linked to dUTP for direct labeling. Cy3.5 and Cy7 are available as avidin or anti-digoxygenin conjugates for secondary detection of biotin- or digoxygenin-labeled probes.

Detection labels that are incorporated into nucleic acid, such as biotin, can be subsequently detected using sensitive methods well-known in the art. For example, biotin can be detected using streptavidin-alkaline phosphatase conjugate (Tropix, Inc.), which is bound to the biotin and subsequently detected by chemiluminescence of suitable substrates (for example, chemiluminescent substrate CSPD: disodium, 3-(4-methoxyspiro-[1,2,-dioxetane-3-2'-(5'-chloro)tricyclo [3.3.1.1$^{3,7}$]decane]-4-yl) phenyl phosphate; Tropix, Inc.). Labels can also be enzymes, such as alkaline phosphatase, soybean peroxidase, horseradish peroxidase and polymerases, that can be detected, for example, with chemical signal amplification or by using a substrate to the enzyme which produces light (for example, a chemiluminescent 1,2-dioxetane substrate) or fluorescent signal.

Molecules that combine two or more of these detection labels are also considered detection labels. Any of the known detection labels can be used with the disclosed probes, tags, molecules and methods to label and detect activated or deactivated aptamers, riboswitches, or nucleic acid or protein produced in the disclosed methods. Methods for detecting and measuring signals generated by detection labels are also known to those of skill in the art. For example, radioactive isotopes can be detected by scintillation counting or direct visualization; fluorescent molecules can be detected with fluorescent spectrophotometers; phosphorescent molecules can be detected with a spectrophotometer or directly visualized with a camera; enzymes can be detected by detection or visualization of the product of a reaction catalyzed by the enzyme; antibodies can be detected by detecting a secondary detection label coupled to the antibody. As used herein, detection molecules are molecules which interact with a compound or composition to be detected and to which one or more detection labels are coupled.

J. Sequence Similarities

It is understood that as discussed herein the use of the terms homology and identity mean the same thing as similarity. Thus, for example, if the use of the word homology is used between two sequences (non-natural sequences, for example) it is understood that this is not necessarily indicating an evolutionary relationship between these two sequences, but rather is looking at the similarity or relatedness between their nucleic acid sequences. Many of the methods for determining homology between two evolutionarily related molecules are routinely applied to any two or more nucleic acids or proteins for the purpose of measuring sequence similarity regardless of whether they are evolutionarily related or not.

In general, it is understood that one way to define any known variants and derivatives or those that might arise, of the disclosed riboswitches, aptamers, expression platforms, genes and proteins herein, is through defining the variants and derivatives in terms of homology to specific known sequences. This identity of particular sequences disclosed herein is also discussed elsewhere herein. In general, variants of riboswitches, aptamers, expression platforms, genes and proteins herein disclosed typically have at least, about 70, 71, 72, 73, 74, 75, 76, 77, 78, 79, 80, 81, 82, 83, 84, 85, 86, 87, 88, 89, 90, 91, 92, 93, 94, 95, 96, 97, 98, or 99 percent homology to a stated sequence or a native sequence. Those of skill in the art readily understand how to determine the homology of two proteins or nucleic acids, such as genes. For example, the homology can be calculated after aligning the two sequences so that the homology is at its highest level.

Another way of calculating homology can be performed by published algorithms. Optimal alignment of sequences for comparison can be conducted by the local homology algorithm of Smith and Waterman Adv. Appl. Math. 2: 482 (1981), by the homology alignment algorithm of Needleman and Wunsch, J. MoL Biol. 48: 443 (1970), by the search for similarity method of Pearson and Lipman, Proc. Natl. Acad. Sci. U.S.A. 85: 2444 (1988), by computerized implementations of these algorithms (GAP, BESTFIT, FASTA, and TFASTA in the Wisconsin Genetics Software Package, Genetics Computer Group, 575 Science Dr., Madison, Wis.), or by inspection.

The same types of homology can be obtained for nucleic acids by for example the algorithms disclosed in Zuker, M. Science 244:48-52, 1989, Jaeger et al. *Proc. Natl. Acad. Sci. USA* 86:7706-7710, 1989, Jaeger et al. *Methods Enzymol.* 183:281-306, 1989 which are herein incorporated by reference for at least material related to nucleic acid alignment. It is understood that any of the methods typically can be used and that in certain instances the results of these various methods can differ, but the skilled artisan understands if identity is found with at least one of these methods, the sequences would be said to have the stated identity.

For example, as used herein, a sequence recited as having a particular percent homology to another sequence refers to sequences that have the recited homology as calculated by any one or more of the calculation methods described above. For example, a first sequence has 80 percent homology, as defined herein, to a second sequence if the first sequence is calculated to have 80 percent homology to the second sequence using the Zuker calculation method even if the first sequence does not have 80 percent homology to the second sequence as calculated by any of the other calculation methods. As another example, a first sequence has 80 percent homology, as defined herein, to a second sequence if the first sequence is calculated to have 80 percent homology to the second sequence using both the Zuker calculation method and the Pearson and Lipman calculation method even if the first sequence does not have 80 percent homology to the second sequence as calculated by the Smith and Waterman calculation method, the Needleman and Wunsch calculation method, the Jaeger calculation methods, or any of the other calculation methods. As yet another example, a first sequence has 80 percent homology, as defined herein, to a second sequence if the first sequence is calculated to have 80 percent homology to the second sequence using each of calculation methods (although, in practice, the different calculation methods will often result in different calculated homology percentages).

K. Hybridization and Selective Hybridization

The term hybridization typically means a sequence driven interaction between at least two nucleic acid molecules, such as a primer or a probe and a riboswitch or a gene. Sequence driven interaction means an interaction that occurs between two nucleotides or nucleotide analogs or nucleotide derivatives in a nucleotide specific manner. For example, G interacting with C or A interacting with T are sequence driven interactions. Typically sequence driven interactions occur on the Watson-Crick face or Hoogsteen face of the nucleotide. The hybridization of two nucleic acids is affected by a number of conditions and parameters known to those of skill in the art. For example, the salt concentrations, pH, and temperature of the reaction all affect whether two nucleic acid molecules will hybridize.

Parameters for selective hybridization between two nucleic acid molecules are well known to those of skill in the art. For example, in some embodiments selective hybridization conditions can be defined as stringent hybridization conditions. For example, stringency of hybridization is controlled by both temperature and salt concentration of either or both of the hybridization and washing steps. For example, the conditions of hybridization to achieve selective hybridization can involve hybridization in high ionic strength solution (6×SSC or 6×SSPE) at a temperature that is about 12-25° C. below the Tm (the melting temperature at which half of the molecules dissociate from their hybridization partners) followed by washing at a combination of temperature and salt concentration chosen so that the washing temperature is about 5° C. to 20° C. below the Tm. The temperature and salt conditions are readily determined empirically in preliminary experiments in which samples of reference DNA immobilized on filters are hybridized to a labeled nucleic acid of interest and then washed under conditions of different stringencies. Hybridization temperatures are typically higher for DNA-RNA and RNA-RNA hybridizations. The conditions can be used as described above to achieve stringency, or as is known in the art (Sambrook et al., Molecular Cloning: A Laboratory Manual, 2nd Ed., Cold Spring Harbor Laboratory, Cold Spring Harbor, N.Y., 1989; Kunkel et al. Methods Enzymol. 1987:154: 367, 1987 which is herein incorporated by reference for material at least related to hybridization of nucleic acids). A preferable stringent hybridization condition for a DNA: DNA hybridization can be at about 68° C. (in aqueous solution) in 6×SSC or 6×SSPE followed by washing at 68° C. Stringency of hybridization and washing, if desired, can be reduced accordingly as the degree of complementarity desired is decreased, and further, depending upon the G-C or A-T richness of any area wherein variability is searched for. Likewise, stringency of hybridization and washing, if desired, can be increased accordingly as homology desired is increased, and further, depending upon the G-C or A-T richness of any area wherein high homology is desired, all as known in the art.

Another way to define selective hybridization is by looking at the amount (percentage) of one of the nucleic acids bound to the other nucleic acid. For example, in some embodiments selective hybridization conditions would be when at least about, 60, 65, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 percent of the limiting nucleic acid is bound to the non-limiting nucleic acid. Typically, the non-limiting nucleic acid is in for example, 10 or 100 or 1000 fold excess. This type of assay can be performed at under conditions where both the limiting and non-limiting nucleic acids are for example, 10 fold or 100 fold or 1000 fold below their $k_d$, or where only one of the nucleic acid molecules is 10 fold or 100 fold or 1000 fold or where one or both nucleic acid molecules are above their $k_d$.

Another way to define selective hybridization is by looking at the percentage of nucleic acid that gets enzymatically manipulated under conditions where hybridization is required to promote the desired enzymatic manipulation. For example, in some embodiments selective hybridization conditions would be when at least about, 60, 65, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 percent of the nucleic acid is enzymatically manipulated under conditions which promote the enzymatic manipulation, for example if the enzymatic manipulation is DNA extension, then selective hybridization conditions would be when at least about 60, 65, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 percent of the nucleic acid molecules are extended. Preferred conditions also include those suggested by the manufacturer or indicated in the art as being appropriate for the enzyme performing the manipulation.

Just as with homology, it is understood that there are a variety of methods herein disclosed for determining the level of hybridization between two nucleic acid molecules. It is understood that these methods and conditions can provide different percentages of hybridization between two nucleic acid molecules, but unless otherwise indicated meeting the parameters of any of the methods would be sufficient. For example if 80% hybridization was required and as long as hybridization occurs within the required parameters in any one of these methods it is considered disclosed herein.

It is understood that those of skill in the art understand that if a composition or method meets any one of these criteria for determining hybridization either collectively or singly it is a composition or method that is disclosed herein.

L. Nucleic Acids

There are a variety of molecules disclosed herein that are nucleic acid based, including, for example, riboswitches, aptamers, and nucleic acids that encode riboswitches and aptamers. The disclosed nucleic acids can be made up of for example, nucleotides, nucleotide analogs, or nucleotide substitutes. Non-limiting examples of these and other molecules are discussed herein. It is understood that for example, when a vector is expressed in a cell, the expressed mRNA will typically be made up of A, C, G, and U. Likewise, it is understood that if a nucleic acid molecule is introduced into a cell or cell environment through for example exogenous delivery, it is advantageous that the nucleic acid molecule be made up of nucleotide analogs that reduce the degradation of the nucleic acid molecule in the cellular environment.

So long as their relevant function is maintained, riboswitches, aptamers, expression platforms, inhibitor nucleic acid molecules, and any other oligonucleotides and nucleic acids can be made up of or include modified nucleotides (nucleotide analogs). Many modified nucleotides are known and can be used in oligonucleotides and nucleic acids. A nucleotide analog is a nucleotide which contains some type of modification to either the base, sugar, or phosphate moieties. Modifications to the base moiety would include natural and synthetic modifications of A, C, G, and T/U as well as different purine or pyrimidine bases, such as uracil-5-yl, hypoxanthin-9-yl (I), and 2-aminoadenin-9-yl. A modified base includes but is not limited to 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 8-azaguanine and 8-azaadenine, 7-deazaguanine and 7-deazaadenine and 3-deazaguanine and 3-deazaadenine. Additional base modifications can be found for example in U.S. Pat. No. 3,687,808, Englisch et al., Angewandte Chemie, International Edition, 1991, 30, 613, and Sanghvi, Y. S., Chapter 15, Antisense Research and Applications, pages 289-302, Crooke, S. T. and Lebleu, B. ed., CRC Press, 1993. Certain nucleotide analogs, such as 5-substituted pyrimidines, 6-azapyrimidines and N-2, N-6 and O-6 substituted purines, including 2-aminopropyladenine, 5-propynyluracil and 5-propynylcytosine. 5-methylcytosine can increase the stability of duplex formation. Other modified bases are those that function as universal bases. Universal bases include 3-nitropyrrole and 5-nitroindole. Universal bases substitute for the normal bases but have no bias in base pairing. That is, universal bases can base pair with any other base. Base modifications often can be combined with for example a sugar modification, such as 2'-O-methoxyethyl, to achieve unique properties such as increased duplex stability. There are numerous United States patents such as U.S. Pat. Nos. 4,845,205; 5,130,302; 5,134,066; 5,175,273; 5,367,066; 5,432,272; 5,457,187; 5,459,255; 5,484,908; 5,502,177; 5,525,711; 5,552,540; 5,587,469; 5,594,121, 5,596,091; 5,614,617; and 5,681,941, which detail and describe a range of base modifications. Each of these patents is herein incorporated by reference in its entirety, and specifically for their description of base modifications, their synthesis, their use, and their incorporation into oligonucleotides and nucleic acids.

Nucleotide analogs can also include modifications of the sugar moiety. Modifications to the sugar moiety would include natural modifications of the ribose and deoxyribose as well as synthetic modifications. Sugar modifications include but are not limited to the following modifications at the 2' position: OH; F; O-, S-, or N-alkyl; O-, S-, or N-alkenyl; O-, S- or N-alkynyl; or O-alkyl-O-alkyl, wherein the alkyl, alkenyl and alkynyl can be substituted or unsubstituted C1 to C10, alkyl or C2 to C10 alkenyl and alkynyl. 2' sugar modifications also include but are not limited to —O[(CH$_2$)n O]m CH$_3$, —O(CH$_2$)n OCH$_3$, —O(CH$_2$)n NH$_2$, —O(CH$_2$)n CH$_3$, —O(CH$_2$)n —ONH$_2$, and —O(CH$_2$)nON[(CH$_2$)n CH$_3$)]$_2$, where n and m are from 1 to about 10.

Other modifications at the 2' position include but are not limited to: C1 to C10 lower alkyl, substituted lower alkyl, alkaryl, aralkyl, O-alkaryl or O-aralkyl, SH, SCH$_3$, OCN, Cl, Br, CN, CF$_3$, OCF$_3$, SOCH$_3$, SO$_2$ CH$_3$, ONO$_2$, NO$_2$, N$_3$, NH$_2$, heterocycloalkyl, heterocycloalkaryl, aminoalkylamino, polyalkylamino, substituted silyl, an RNA cleaving group, a reporter group, an intercalator, a group for improving the pharmacokinetic properties of an oligonucleotide, or a group for improving the pharmacodynamic properties of an oligonucleotide, and other substituents having similar properties. Similar modifications can also be made at other positions on the sugar, particularly the 3' position of the sugar on the 3' terminal nucleotide or in 2'-5' linked oligonucleotides and the 5' position of 5' terminal nucleotide. Modified sugars would also include those that contain modifications at the bridging ring oxygen, such as CH$_2$ and S. Nucleotide sugar analogs can also have sugar mimetics such as cyclobutyl moieties in place of the pentofuranosyl sugar. There are numerous United States patents that teach the preparation of such modified sugar structures such as U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, each of which is herein incorporated by reference in its entirety, and specifically for their description of modified sugar structures, their synthesis, their use, and their incorporation into nucleotides, oligonucleotides and nucleic acids.

Nucleotide analogs can also be modified at the phosphate moiety. Modified phosphate moieties include but are not limited to those that can be modified so that the linkage between two nucleotides contains a phosphorothioate, chiral phosphorothioate, phosphorodithioate, phosphotriester, aminoalkylphosphotriester, methyl and other alkyl phosphonates including 3'-alkylene phosphonate and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates. It is understood that these phosphate or modified phosphate linkages between two nucleotides can be through a 3'-5' linkage or a 2'-5' linkage, and the linkage can contain inverted polarity such as 3'-5' to 5'-3' or 2'-5' to 5'-2'. Various salts, mixed salts and free acid forms are also included. Numerous United States patents teach how to make and use nucleotides containing modified phosphates and include but are not limited to, U.S. Pat. Nos. 3,687,808; 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,306; 5,550,111; 5,563,253; 5,571,799; 5,587,361; and 5,625,050, each of which is herein incorporated by reference its entirety, and specifically for their description of modified phosphates, their synthesis, their use, and their incorporation into nucleotides, oligonucleotides and nucleic acids.

It is understood that nucleotide analogs need only contain a single modification, but can also contain multiple modifications within one of the moieties or between different moieties.

Nucleotide substitutes are molecules having similar functional properties to nucleotides, but which do not contain a phosphate moiety, such as peptide nucleic acid (PNA).

Nucleotide substitutes are molecules that will recognize and hybridize to (base pair to) complementary nucleic acids in a Watson-Crick or Hoogsteen manner, but which are linked together through a moiety other than a phosphate moiety. Nucleotide substitutes are able to conform to a double helix type structure when interacting with the appropriate target nucleic acid.

Nucleotide substitutes are nucleotides or nucleotide analogs that have had the phosphate moiety and/or sugar moieties replaced. Nucleotide substitutes do not contain a standard phosphorus atom. Substitutes for the phosphate can be for example, short chain alkyl or cycloalkyl internucleoside linkages, mixed heteroatom and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and CH2 component parts. Numerous United States patents disclose how to make and use these types of phosphate replacements and include but are not limited to U.S. Pat. Nos. 5,034,506; 5,166,315; 5,185,444; 5,214,134; 5,216,141; 5,235,033; 5,264,562; 5,264,564; 5,405,938; 5,434,257; 5,466,677; 5,470,967; 5,489,677; 5,541,307; 5,561,225; 5,596,086; 5,602,240; 5,610,289; 5,602,240; 5,608,046; 5,610,289; 5,618,704; 5,623,070; 5,663,312; 5,633,360; 5,677,437; and 5,677,439, each of which is herein incorporated by reference its entirety, and specifically for their description of phosphate replacements, their synthesis, their use, and their incorporation into nucleotides, oligonucleotides and nucleic acids.

It is also understood in a nucleotide substitute that both the sugar and the phosphate moieties of the nucleotide can be replaced, by for example an amide type linkage (aminoethylglycine) (PNA). U.S. Pat. Nos. 5,539,082; 5,714,331; and 5,719,262 teach how to make and use PNA molecules, each of which is herein incorporated by reference. (See also Nielsen et al., *Science* 254:1497-1500 (1991)).

Oligonucleotides and nucleic acids can be comprised of nucleotides and can be made up of different types of nucleotides or the same type of nucleotides. For example, one or more of the nucleotides in an oligonucleotide can be ribonucleotides, 2'-O-methyl ribonucleotides, or a mixture of ribonucleotides and 2'-O-methyl ribonucleotides; about 10% to about 50% of the nucleotides can be ribonucleotides, 2'-O-methyl ribonucleotides, or a mixture of ribonucleotides and 2'-O-methyl ribonucleotides; about 50% or more of the nucleotides can be ribonucleotides, 2'-O-methyl ribonucleotides, or a mixture of ribonucleotides and 2'-O-methyl ribonucleotides; or all of the nucleotides are ribonucleotides, 2'-O-methyl ribonucleotides, or a mixture of ribonucleotides and 2'-O-methyl ribonucleotides. Such oligonucleotides and nucleic acids can be referred to as chimeric oligonucleotides and chimeric nucleic acids.

M. Solid Supports

Solid supports are solid-state substrates or supports with which molecules (such as trigger molecules) and aptamers or riboswitches (or other components used in, or produced by, the disclosed methods) can be associated. Aptamers, riboswitches and other molecules can be associated with solid supports directly or indirectly. For example, analytes (e.g., trigger molecules, test compounds) can be bound to the surface of a solid support or associated with capture agents (e.g., compounds or molecules that bind an analyte) immobilized on solid supports. As another example, aptamers or riboswitches can be bound to the surface of a solid support or associated with probes immobilized on solid supports. An array is a solid support to which multiple riboswitches, probes or other molecules have been associated in an array, grid, or other organized pattern.

Solid-state substrates for use in solid supports can include any solid material with which components can be associated, directly or indirectly. This includes materials such as acrylamide, agarose, cellulose, nitrocellulose, glass, gold, polystyrene, polyethylene vinyl acetate, polypropylene, polymethacrylate, polyethylene, polyethylene oxide, polysilicates, polycarbonates, teflon, fluorocarbons, nylon, silicon rubber, polyanhydrides, polyglycolic acid, polylactic acid, polyorthoesters, functionalized silane, polypropylfumerate, collagen, glycosaminoglycans, and polyamino acids. Solid-state substrates can have any useful form including thin film, membrane, bottles, dishes, fibers, woven fibers, shaped polymers, particles, beads, microparticles, or a combination. Solid-state substrates and solid supports can be porous or non-porous. A chip is a rectangular or square small piece of material. Preferred forms for solid-state substrates are thin films, beads, or chips. A useful form for a solid-state substrate is a microtiter dish. In some embodiments, a multiwell glass slide can be employed.

An array can include a plurality of aptamers, riboswitches, trigger molecules, other molecules, compounds or probes immobilized at identified or predefined locations on the solid support. Each predefined location on the solid support generally has one type of component (that is, all the components at that location are the same). Alternatively, multiple types of components can be immobilized in the same predefined location on a solid support. Each location will have multiple copies of the given components. The spatial separation of different components on the solid support allows separate detection and identification.

Although useful, it is not required that the solid support be a single unit or structure. A set of aptamers, riboswitches, trigger molecules, other molecules, compounds and/or probes can be distributed over any number of solid supports. For example, at one extreme, each component can be immobilized in a separate reaction tube or container, or on separate beads or microparticles.

Methods for immobilization of oligonucleotides to solid-state substrates are well established. Oligonucleotides, including address probes and detection probes, can be coupled to substrates using established coupling methods. For example, suitable attachment methods are described by Pease et al., *Proc. Natl. Acad. Sci. USA* 91(11):5022-5026 (1994), and Khrapko et al., *Mol Biol* (*Mosk*) (*USSR*) 25:718-730 (1991). A method for immobilization of 3'-amine oligonucleotides on casein-coated slides is described by Stimpson et al., *Proc. Natl. Acad. Sci. USA* 92:6379-6383 (1995). A useful method of attaching oligonucleotides to solid-state substrates is described by Guo et al., *Nucleic Acids Res.* 22:5456-5465 (1994).

Each of the components (for example, riboswitches, trigger molecules, or other molecules) immobilized on the solid support can be located in a different predefined region of the solid support. The different locations can be different reaction chambers. Each of the different predefined regions can be physically separated from each other of the different regions. The distance between the different predefined regions of the solid support can be either fixed or variable. For example, in an array, each of the components can be arranged at fixed distances from each other, while components associated with beads will not be in a fixed spatial relationship. In particular, the use of multiple solid support units (for example, multiple beads) will result in variable distances.

Components can be associated or immobilized on a solid support at any density. Components can be immobilized to the solid support at a density exceeding 400 different components per cubic centimeter. Arrays of components can have any number of components. For example, an array can have at least 1,000 different components immobilized on the solid support, at least 10,000 different components immobilized on the solid support, at least 100,000 different components immobilized on the solid support, or at least 1,000,000 different components immobilized on the solid support.

N. Kits

The compositions described above as well as other compositions and materials can be packaged together in any suitable combination as a kit useful for performing, or aiding in the performance of, the disclosed method. It is useful if the kit components in a given kit are designed and adapted for use together in the disclosed method. For example disclosed are kits for detecting compounds, the kit comprising one or more biosensor riboswitches. The kits also can contain reagents and labels for detecting activation of the riboswitches.

O. Mixtures

Disclosed are mixtures formed by performing or preparing to perform the disclosed method. For example, disclosed are mixtures comprising riboswitches and trigger molecules.

Whenever the method involves mixing or bringing into contact compositions or components or reagents, performing the method creates a number of different mixtures. For example, if the method includes 3 mixing steps, after each one of these steps a unique mixture is formed if the steps are performed separately. In addition, a mixture is formed at the completion of all of the steps regardless of how the steps were performed. The present disclosure contemplates these mixtures, obtained by the performance of the disclosed methods as well as mixtures containing any disclosed reagent, composition, or component, for example, disclosed herein.

P. Systems

Disclosed are systems useful for performing, or aiding in the performance of, the disclosed method. Systems generally comprise combinations of articles of manufacture such as structures, machines, devices, and the like, and compositions, compounds, materials, and the like. Such combinations that are disclosed or that are apparent from the disclosure are contemplated. For example, disclosed and contemplated are systems including biosensor riboswitches, a solid support and a signal-reading device.

Q. Data Structures and Computer Control

Disclosed are data structures used in, generated by, or generated from, the disclosed method. Data structures generally are any form of data, information, and/or objects collected, organized, stored, and/or embodied in a composition or medium. Riboswitch structures and activation measurements stored in electronic form, such as in RAM or on a storage disk, is a type of data structure.

The disclosed method, or any part thereof or preparation therefor, can be controlled, managed, or otherwise assisted by computer control. Such computer control can be accomplished by a computer controlled process or method, can use and/or generate data structures, and can use a computer program. Such computer control, computer controlled processes, data structures, and computer programs are contemplated and should be understood to be disclosed herein.

Methods

Disclosed are methods of making, using, and relating to fluoride aptamers, fluoride-responsive riboswitches, fluoride-regulated expression constructs, fluoride transporters, nucleic acids encoding fluoride transporters, expression constructs encoding fluoride transporters, and cells containing or including any combination of these. The disclosed methods include, for example, fluoride sensing, removal of fluoride form mixtures, purifying fluoride from mixtures, regulating gene expression (using fluoride-responsive riboswitches and fluoride-regulated expression constructs, for example), recombinant production of expression products (using fluoride-responsive riboswitches and fluoride-regulated expression constructs, for example), controlling cells, killing cells, inhibiting cell growth (using fluoride and compounds and compositions that increase the toxicity of fluoride, for example), identifying compounds that affect fluoride-responsive riboswitches, identifying compounds that affect fluoride transporters, identifying compounds that affect fluoride levels in cells, identifying compounds that affect fluoride uptake by cells, identifying compounds that inhibit fluoride transport by fluoride transporters, growing cells in the presence of high fluoride levels, and degradation or removal of organic compounds from an environment having fluoride.

Fluoride-sensing riboswitches can directly serve as a major target for compounds that enhance fluoride toxicity. Compounds that bind to and inhibit riboswitch action can preclude the expression of genes necessary for cells to overcome fluoride toxicity. For organisms that use riboswitches to control the expression of CrcB or EriC$^F$ proteins, riboswitch antagonists can increase fluoride in cells to toxic levels by blocking export by these fluoride transporters. Other riboswitch classes also should be amenable to inhibition, which for certain examples will disrupt bacterial growth. For example, inhibition of riboswitch classes responsive to the bacterial second messenger c-di-GMP (Lee et al. 2010. An allosteric self-splicing ribozyme triggered by a bacterial second messenger. Science 329:845-848; Sudarsan et al. 2008. Riboswitches in eubacterial sense the second messenger cyclic di-GMP. Science 321:411-413) can disrupt diverse physiological changes in bacterial pathogens (e.g. virulence gene expression, motility, biofilms formation) due to the widespread importance of this riboswitch classes. Simple variation of the high throughput (HTP) screening methods described herein can be applied to screen for riboswitch inhibitors. Although there are numerous publications on riboswitch agonist compounds (Sudarsan et al. 2005. Thiamine pyrophosphate riboswitches are targets for the antimicrobial compound pyrithiamine. Chem Biol 12:1325-1335; Blount et al. 2007. Antibacterial lysine analogs that target lysine riboswitches. Nature Chem Biol 3:44-49; Kim J N, et al. 2009. Design and antimicrobial action of purine analogues that bind guanine riboswitches. ACS Chem Biol 4:915-927; Lee et al. 2009. Roseoflavin is a natural antibacterial compound that binds to FMN riboswitches and regulates gene expression. RNA Biol 6:187-194; Blount and Breaker 2007. Riboswitches as antibacterial drug targets. Nature Biotechnol 24:1558-1564), the description of a riboswitch antagonist is unprecedented.

Isolation of fluoride riboswitch inhibitors can make use of the same reporter systems described herein with, for example, the WT B. subtilis strain as the host. However, the culture medium can be supplemented with 100 mM fluoride to trigger high reporter gene expression at all times. Compounds that disrupt riboswitch function can preclude expression of the reporter gene, thus reducing β-galactosidase activity (or other reporter signal). This assay design is receptive to all other riboswitch classes, and therefore other key classes whose disruption could have great utility (e.g. the c-di-GMP riboswitches) can be similarly targeted with the proper riboswitch-reporter fusion constructs.

There are several possible mechanisms for compounds that yield false positives, such as transcription inhibitors, translation inhibitors, or reporter protein inhibitors. However, compounds that give false positives all can be quickly identified by demonstrating that their activity is not eliminated by using a reporter construct lacking the riboswitch and that constitutively expressed the reporter gene.

A. Methods of Fluoride Sensing

The disclosed fluoride aptamers, fluoride-responsive riboswitches, and fluoride transporters can be used to detect or sense the presence of fluoride. Methods of sensing fluoride are provided. The methods can include bringing into contact a sample or an environment to be assessed and any of the disclosed cells, wherein expression of the coding region produces a signal. The signal can indicate the presence of fluoride in the sample or environment.

The methods can also include bringing into contact a sample or an environment to be assessed and a cell including any of the disclosed fluoride aptamer nucleic acid molecules. The fluoride aptamer can be operably linked to a signal-generating component and the signal-generating component can generate a signal when the fluoride aptamer is bound by fluoride. The signal can indicate the presence of fluoride in the sample or environment.

In some forms, the methods can include bringing into contact a sample or an environment to be assessed and any one of the fluoride aptamer nucleic acid molecules disclosed herein. The signal can indicate the presence of fluoride in the sample or environment. The level of signal produced in the disclosed methods can indicate the level of fluoride in the sample or the environment.

Samples can be of any form and from any source. An environment refers to any place, location, material, surface, etc. For example, an environment can be in or on soil, water, air, fluids, solids, gels, glasses, crystals, plants, animals, microorganisms, organs, tissues, cells, buildings, furniture, food, products, hospitals, restaurants, factories, farms, homes, etc. Samples can be obtained from any source or environment.

B. Methods of Removing or Purifying Fluoride from Mixtures

The disclosed fluoride aptamers and fluoride transporters can be used to remove or separate fluoride form mixtures. Methods of separating fluoride from a mixture are provided. The methods can include bringing into contact the mixture and any of the fluoride aptamer nucleic acid molecules disclosed herein, and separating the fluoride aptamer nucleic acid molecule from the mixture via the sequestration tag, thereby separating fluoride from the mixture.

The fluoride aptamer nucleic acid molecule can be separated by bringing into contact the fluoride aptamer nucleic acid molecule and a solid support including a binding agent, wherein the binding agent binds the sequestration tag.

Bringing into contact the mixture and the fluoride aptamer nucleic acid molecule and bringing into contact the fluoride aptamer nucleic acid molecule and the solid support can be accomplished together by passing the mixture through or over the solid support. The solid support can include the fluoride aptamer nucleic acid molecule and the fluoride aptamer nucleic acid molecule can be conjugated to the solid support via the sequestration tag. The methods can further include, following bringing into contact the fluoride aptamer nucleic acid molecule and the solid support, washing the solid support.

The methods can include bringing into contact the mixture and a solid support and the solid support can include any of the disclosed fluoride aptamer nucleic acid molecules. Also disclosed is the separating of the mixture from the solid support, thereby separating fluoride from the mixture.

The methods can include bringing into contact the mixture and any of the disclosed cells. The fluoride aptamer nucleic acid molecules can be sequestered in an inclusion body, thereby separating fluoride from the mixture. The fluoride aptamer nucleic acid molecule can be sequestered in an inclusion body via the sequestration tag. These methods further include separating the cell from the mixture.

C. Methods for Regulating Gene Expression of Expression Constructs

The disclosed fluoride aptamers and fluoride-responsive riboswitches can be used to regulate gene expression. Methods of regulating gene expression are provided. For example, fluoride can be used to activate any of the disclosed fluoride-responsive riboswitches. Fluoride-regulated expression constructs can be regulated via fluoride, thus providing fluoride-regulated expression of the expression construct. The methods can include bringing into contact fluoride and any of the disclosed cells, whereby the fluoride can alter the expression of a coding region in the expression construct. The level of expression can vary based on the level of fluoride.

The methods can also include bringing into contact a compound and any of the disclosed cells. The compound can alter the expression of the fluoride-responsive riboswitch. The compound can inhibit activation of the fluoride-responsive riboswitch by fluoride or the compound can activate the fluoride-responsive riboswitch.

The disclosed regulation of gene expression can be used to regulate and allow production of expression products. Thus, also disclosed are methods of producing an expression product. The methods can include bringing into contact fluoride and any of the disclosed cells, whereby the expression product can be produced via expression of the fluoride-regulated expression construct.

Also disclosed are methods of regulating gene expression, the method comprising bringing into contact fluoride and one or more of the disclosed cells, where the cells comprise one or more of the disclosed fluoride-regulated expression constructs, whereby the fluoride alters the expression of a coding region in the expression construct. In some forms, the level of expression can vary based on the level of fluoride.

Also disclosed are methods of regulating gene expression, the method comprising bringing into contact a compound and one or more of the disclosed cells, where the cells comprise one or more of the disclosed fluoride-regulated expression constructs, where the compound alters the expression of the fluoride-responsive riboswitch. In some forms, the compound can inhibit activation of the fluoride-responsive riboswitch by fluoride. In some forms, the compound can activate the fluoride-responsive riboswitch.

Also disclosed are methods of producing an expression product, the method comprising bringing into contact fluoride and one or more of the disclosed cells, where the cells comprise one or more of the disclosed fluoride-regulated expression constructs, whereby the expression product is produced via expression of the fluoride-regulated expression construct.

D. Methods of Controlling Cells

Cell growth and viability can be affected using the disclosed compounds, compositions, and methods. This can be referred to as control of cells. For example, cells can be controlled by killing the cells using the disclosed methods. Methods of controlling cells are provided. The methods can include exposing the disclosed cells to fluoride, thereby causing the cell to die. Exposing the disclosed cells to fluoride can also cause the cell to enter stasis. Exposing the disclosed cells to fluoride can also inhibit cell growth. The effectiveness of fluoride on the cell can be increased by also exposing the cell to compounds and compositions that affect fluoride transport. For example, cells can be controlled by inhibiting function of fluoride-responsive riboswitches, inhibiting function of fluoride transporters, making the cell membrane more permeable to fluoride, etc. Such effects can make the cell more sensitive to fluoride by, for example, increasing the level of fluoride in the cell.

Disclosed are methods of controlling cells, the method comprising exposing one or more of the disclosed cells to fluoride, thereby causing the cell to die, where the cells comprise one or more of the disclosed fluoride-regulated expression constructs, where expression of the coding region induces or causes death of the cell.

Disclosed are methods of controlling cells, the method comprising exposing one or more of the disclosed cells to fluoride, thereby causing the cell to enter stasis, where the cells comprise one or more of the disclosed fluoride-regulated expression constructs, where expression of the coding region induces or causes stasis of the cell.

E. Methods of Altering Gene Expression

Gene expression can be altered using the disclosed compounds and compositions. For example, expression of genes containing fluoride-responsive riboswitches or comprised in fluoride-regulated expression constructs can be altered. Methods of altering gene expression are disclosed. The methods can include bringing into contact a compound and a cell. The cell can include a gene encoding an RNA including a fluoride-responsive riboswitch and the compound can affect expression of the riboswitch. The compound can, for example, inhibit activation of the fluoride-responsive riboswitch by fluoride or can activate the fluoride-responsive riboswitch.

Also disclosed are methods of altering gene expression including bringing into contact fluoride and a cell. The cell can include a gene encoding an RNA including a fluoride-responsive riboswitch and fluoride can affect expression of the riboswitch. The level of expression can vary based on the level of fluoride.

Disclosed are methods of altering gene expression, the method comprising bringing into contact a compound and a cell, wherein the cell comprises a gene encoding an RNA comprising a fluoride-responsive riboswitch, wherein the compound affects expression of the riboswitch.

Disclosed are methods of altering gene expression, the method comprising bringing into contact fluoride and a cell, wherein the cell comprises a gene encoding an RNA comprising a fluoride-responsive riboswitch, wherein fluoride affects expression of the riboswitch.

In some forms, the level of expression can vary based on the level of fluoride. In some forms, the compound can inhibit activation of the fluoride-responsive riboswitch by fluoride. In some forms, the compound can activate the fluoride-responsive riboswitch.

F. Methods for Screening for Compounds that Affect Fluoride-Responsive Riboswitches As described herein, compounds and compositions that affect fluoride-responsive riboswitches can be used for a variety of purposes. Thus, it is useful to identify compounds and compositions that can affect fluoride-responsive riboswitches. Methods of identifying compounds that affect expression of fluoride-responsive riboswitches are provided. The methods can include testing a compound for altering gene expression of the fluoride-regulated expression construct of any of the disclosed cells. The alteration can be via the riboswitch. Alteration of expression of the fluoride-regulated expression construct can identify the compound as a compound that affects expression of the fluoride-responsive riboswitch.

Expression of the coding region can produce a signal and the signal can identify the compound as a compound that affects expression of the fluoride-responsive riboswitch.

In some forms, the compounds can inhibit activation of the fluoride-responsive riboswitch by fluoride. In some forms, the compounds can activate the fluoride-responsive riboswitch.

Also disclosed are methods of identifying compounds that affect fluoride aptamers. The methods can include testing a compound for affecting the fluoride aptamer of the disclosed cells. The methods can also include testing a compound for affecting the fluoride aptamer included in the fluoride aptamer nucleic acid molecules disclosed herein. The fluoride aptamer can be operably linked to a signal-generating component and the signal-generating component can generate a signal when the fluoride aptamer is bound by fluoride. A change in the signal can identify the compound as a compound that affects the fluoride aptamer.

The compounds can inhibit activation of the fluoride aptamer by fluoride. The compounds can also activate the fluoride aptamer.

Disclosed are methods of identifying compounds that affect expression of fluoride-responsive riboswitches, the method comprising testing a compound for altering gene expression of one or more of the disclosed fluoride-regulated expression constructs, where the alteration is via the riboswitch, where alteration of expression of the fluoride-regulated expression construct identifies the compound as a compound that affects expression of the fluoride-responsive riboswitch.

In some forms, expression of the coding region can produce a signal, where the signal identifies the compound as a compound that affects expression of the fluoride-responsive riboswitch. In some forms, the compound can inhibit activation of the fluoride-responsive riboswitch by fluoride. In some forms, the compound can activate the fluoride-responsive riboswitch. In some forms, the fluoride-regulated expression constructs can be in a cell.

Disclosed are methods of identifying compounds that affect fluoride aptamers, the method comprising testing a compound for affecting one or more of the disclosed fluoride aptamers, where the fluoride aptamer is operably linked to a signal-generating component, where the signal-generating component generates a signal when the fluoride aptamer is bound by fluoride, where a change in the signal identifies the compound as a compound that affects the fluoride aptamer.

Disclosed are methods of identifying compounds that affect fluoride aptamers, the method comprising testing a compound for affecting one or more of the disclosed fluoride aptamers, where the fluoride aptamer is operably linked to a signal-generating component, where the signal-generating component generates a signal when the fluoride aptamer is bound by fluoride, where a change in the signal identifies the compound as a compound that affects the fluoride aptamer.

In some forms, the compound can inhibit activation of the fluoride aptamer by fluoride. In some forms, the compound can activate the fluoride aptamer. In some forms, the fluoride aptamers can be comprised in one or more of the disclosed fluoride aptamer nucleic acid molecules. In some forms, the fluoride aptamers can be in a cell.

G. Methods of Using Fluoride Transporters

The disclosed fluoride transporters can be used, for example, to alter the effect of fluoride on cells and the sensitivity of fluoride on cells. For example, fluoride transporters in a cell can be inhibited, thus increasing the level of fluoride in the cells and/or making the cells more sensitive to fluoride. As another example, fluoride transporter can be expressed in cells, or expressed at a higher level in cells, thus decreasing the level of fluoride in the cells and/or making the cells less sensitive to fluoride. Cells that are made less sensitive to fluoride can be used, for example, to grow in high fluoride environments. This can allow such cells to function and have an effect in such environments. This can also allow such cells to outcompete, outgrow, be less affected by, etc. other cells that are more sensitive to fluoride.

Disclosed are methods of growing cells, the method comprising incubating one or more of the disclosed cells in the presence of a high fluoride concentration, where the cell comprises one or more of the disclosed expression constructs that encodes a fluoride transporter. In some forms, the fluoride transporter can be heterologous to the cell. In some forms, the cell is capable of degrading at least one fluorinated compound, where degradation of the fluorinated compound contributes to or creates the high fluoride concentration. In some forms, the cell comprises at least one heterologous enzyme involved in degradation of fluorinated compounds.

As used herein, a high fluoride environment is an environment having 50% greater or more fluoride concentration, level, amount, etc. as compared to the average or a typical concentration, level, amount for that type of environment. As used herein, a high fluoride concentration is a fluoride concentration 50% greater or more than the fluoride concentration that is average or typical for the context involved. However, it is understood that fluoride concentrations, levels, amounts, etc. in environments or contexts where fluoride has been added or introduced (such as fluoridated toothpaste or drinking water) can be considered to have high concentrations, levels, amounts, etc. of fluoride even though the fluoride concentration is typical (for fluoridated toothpaste or water, for example). In such cases, the average or typical fluoride concentration, level, amount, etc. used should be a similar environment or context where fluoride has not been added or introduced.

Also disclosed are methods of inhibiting a fluoride transporter, the method comprising bringing into contact the fluoride transporter and a compound that inhibits a fluoride transporter, wherein the compound has the structure

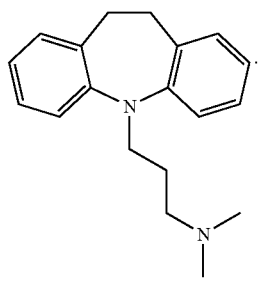

Also disclosed are methods for increasing the concentration of fluoride in a cell, the method comprising bringing into contact the cell and one or more compounds identified by any one of the disclosed methods for identifying compounds that increases fluoride concentration in a cell.

Also disclosed are methods for increasing the concentration of fluoride in a cell, the method comprising bringing into contact the cell and one or more compounds identified by any one of the disclosed methods for identifying compounds that that affect expression of fluoride-responsive riboswitches.

Also disclosed are methods for identifying compounds that increases fluoride concentration in a cell, the method comprising detecting fluoride concentration in a cell in the presence and in the absence of a test compound, wherein an increase in fluoride concentration in the presence of the test compound identifies the test compound as a compound that increases fluoride concentration in the cell.

In some forms, the cell can comprise a fluoride-sensing element. In some forms, the fluoride-sensing element can comprise a fluoride-regulated expression construct comprising a nucleic acid molecule encoding a fluoride-responsive riboswitch operably linked to a coding region, where expression of the coding region is regulated by the riboswitch, where expression of the coding region produces a signal, where the signal indicates the presence of fluoride in the cell. In some forms, the fluoride-sensing element can comprise a fluoride aptamer operably linked to a signal-generating component, where the signal-generating component generates a signal when the fluoride aptamer is bound by fluoride, where the signal indicates the presence of fluoride in the cell. In some forms, the cell can lack a native fluoride transporter. In some forms, the cell can comprise a heterologous fluoride transporter.

In some forms of the methods, the fluoride concentration in a second cell can be detected in the presence and in the absence of the test compound, where the second cell lacks a fluoride transporter. In some forms, a higher fluoride concentration in the first cell in the presence of the test compound as compared to the fluoride concentration in the second cell in the presence of the test compound can identify the test compound as a compound that enhances fluoride uptake by the cell. In some forms, a substantially similar fluoride concentration in the first cell and the second cell in the presence of the test compound can identify the test compound as a compound that inhibits fluoride transport by the fluoride transporter. By substantially similar is meant that a concentration, level amount, etc. is within 10% of another concentration, level, amount, etc.

Also disclosed are methods for identifying compounds that inhibit fluoride transport by fluoride transporters, the method comprising detecting fluoride transport by a fluoride transporter in the presence and in the absence of a test compound, where a reduction in fluoride transport in the presence of the test compound identifies the test compound as a compound that inhibits fluoride transport by the fluoride transporter. In some forms, the fluoride transport can be fluoride transport out of a cell, where the cell comprises the fluoride transporter, where the fluoride transporter is heterologous to the cell.

Methods for identifying compounds that increase fluoride concentration in a cell are provided. The methods can include detecting fluoride concentration in a cell in the presence and in the absence of a test compound. An increase in fluoride concentration in the presence of the test compound can be used to identify the test compound as a compound that increases fluoride concentration in the cell.

The cell can include a fluoride-sensing element. The fluoride-sensing element can include a fluoride-regulated expression construct and the expression construct can include a nucleic acid molecule encoding a fluoride-responsive riboswitch operably linked to a coding region. Expression of the coding region can be regulated by the riboswitch, wherein expression of the coding region can produce a signal and the signal can indicate the presence of fluoride in the cell.

The fluoride-sensing element can also include a fluoride aptamer operably linked to a signal-generating component. The signal-generating component can generate a signal when the fluoride aptamer is bound by fluoride and the signal can be used to indicate the presence of fluoride in the cell.

The cells can lack a native fluoride transporter or can include a heterologous fluoride transporter.

The disclosed methods can further include detecting fluoride concentration in a second cell in the presence and in the absence of the test compound. The second cell can lack a fluoride transporter. A higher fluoride concentration in the first cell in the presence of the test compound as compared to the fluoride concentration in the second cell in the presence of the test compound can be used to identify the test compound as a compound that enhances fluoride uptake by the cell. A substantially similar fluoride concentration in the first cell and the second cell in the presence of the test compound can be used to identify the test compound as a compound that inhibits fluoride transport by the fluoride transporter.

Also provided are methods for identifying compounds that inhibit fluoride transport by fluoride transporters. The methods can include detecting fluoride transport by a fluoride transporter in the presence and in the absence of a test compound. A reduction in fluoride transport in the presence of the test compound can be used to identify the test compound as a compound that inhibits fluoride transport by the fluoride transporter.

The fluoride transport can be a fluoride transport out of a cell, wherein the cell includes the fluoride transporter. The fluoride transporter can be heterologous to the cell.

Methods of growing cells are provided. The methods can include incubating any one of the cells disclosed herein in the presence of a high fluoride concentration. The cells can be capable of degrading at least one fluorinated compound and the degradation of the fluorinated compound can contribute to or create the high fluoride concentration. The cell can include at least one heterologous enzyme involved in degradation of fluorinated compounds.

Further provided are methods of inhibiting a fluoride transporter. The methods can include bringing into contact the fluoride transporter and any of the compounds disclosed herein.

Methods for increasing the concentration of fluoride in a cell are provided. The methods can include bringing into contact the cell and any of the disclosed compounds. For example, the compounds identified by any of the methods of identifying compounds that increase fluoride concentration can be used. The cells can be brought into contact with any of the compounds identified by the methods disclosed herein.

In post-screening analysis, hits can be organized into chemically similar and functionally similar groups. If multiple chemically similar compounds are isolated that cluster into distinct functional groups, pharmacophore classes are defined for further examination by chemical derivatization and testing. Such structure-activity relationship (SAR) analyses are frequently used to define the minimal active portion of hits, which then can be used to create functional analogs that have improved efficacy. Ion channel (trans-porter) blockers are very important for treating human disease, and this study provides an exciting opportunity to identify and optimize useful channel blockers that selectively target the fluoride transporters of bacteria.

Pharmacophores can be identified by searching for similar chemical substructures among hits with similar mechanisms of action. If too few hits are available, key chemical substructures can be identified by purchasing or synthesizing derivatives for evaluation. Numerous studies have been conducted (Lee E R, et al. 2010. An allosteric self-splicing ribozyme triggered by a bacterial second messenger. Science 329:845-848; Winkler W C, et al. 2004. Control of gene expression by a natural metabolite-responsive ribozyme. Nature 428:281-286; Nahvi et al. 2002. Genetic control by a metabolite binding mRNA. Chem Biol 9:1043-1049; Winkler W C, et al. 2002. Thiamine derivatives bind messenger RNAs directly to regulate bacterial gene expression. Nature 419:952-956; Winkler et al. 2002. An mRNA structure that controls gene expression by binding FMN. Proc Natl Acad Sci USA 99:15908-15913; Mandal et al. 2004. A glycine-dependent riboswitch that uses cooperative binding to control gene expression. Science 306:275-279; Sudarsan et al. 2008. Riboswitches in eubacteria sense the second messenger cyclic di-GMP. Science 321:411-413; Corbino K A, et al. 2005. Evidence for a second class of S-adenosylmethionine riboswitches and other regulatory RNA motifs in alphaproteobacteria. Genome Biol 6:R70; Mandal M, et al. 2003. Riboswitches control fundamental biochemical pathways in *Bacillus subtilis* and other bacteria. Cell 113:577-586; Mandal and Breaker 2004. Adenine riboswitches and gene activation by disruption of a transcription terminator. Nature Struct Mol Biol 11:29-35; Kim J N, et al. 2007. Guanine riboswitch variants from Mesoplasma forum selectively recognize 2'-deoxyguanosine. Proc Natl Acad Sci USA 104, 16092-16097; Winkler W C, et al. 2003. An mRNA structure that controls gene expression by binding S-adenosylmethionine. Nature Struct Biol 10:701-707; Roth et al. 2007. A riboswitch selective for the queuosine precursor preQ1 contains an unusually small aptamer domain. Nature Struct Mol Biol 14:308-317; Meyer M M, et al. 2008. Confirmation of a second natural preQ1 aptamer class in *Streptococcaceae* bacteria. RNA 14:685-695) to establish molecular recognition patterns of riboswitches, and to establish key ligand features required for maximal binding affinity. Particularly noteworthy, we have chemically synthesized novel compounds for such applications (Sudarsan N, et al. 2005. Thiamine pyrophosphate riboswitches are targets for the antimicrobial compound pyrithiamine. Chem Biol 12:1325-1335; Blount K F, et al. 2007. Antibacterial lysine analogs that target lysine riboswitches. Nature Chem Biol 3:44-49; Kim J N, et al. 2009. Design and antimicrobial action of purine analogues that bind guanine riboswitches. ACS Chem Biol 4:915-927; Lim J, et al. 2006. Molecular-recognition characteristics of SAM-binding riboswitches. Angew Chem Int Ed Engl 45:964-968; Lim J, et al. 2006. Characteristics of ligand recognition by a glmS self-cleaving ribozyme. Angew Chem Int Ed Engl 45:6689-6693), and have outsourced synthesis of some compounds (Kim J N, et al. 2009. Design and antimicrobial action of purine analogues that bind guanine riboswitches. ACS Chem Biol 4:915-927) when necessary.

Compounds can be assessed for fluoride agonist activity using the biological assays described herein. Iterative design and synthesis of compounds can be conducted to establish each pharmacophore and to yield compounds with improved activity at lower doses. For example, $EriC^F$ fluoride transporter blocking compounds that function at 1 μM or lower to fully enhance fluoride toxicity to the level of a genetic K.O. can be determined.

EXAMPLES

A. Example 1

Identification of Fluoride Transporters

1. Introduction

Fluoride ions present at millimolar concentrations in bacterial culture media have long been known to inhibit cell growth (R. J. Lesher, et al., *Antimicrob. Agents Chemother.* 12, 339 (1977); M. Maltz, C. G. Emilson, *J. Dent. Res.* 61, 786 (1982); R. E. Marquis, et al., *FEMS Microbiol. Rev.* 26, 493 (2003)). There are multiple causes of this toxicity, including the sensitization of bacteria to low pH stress and the inhibition of certain metabolic enzymes (A. Wiseman, In: *Handbook of Experimental Pharmacology*, Vol. XX, O. Eicher, A. Farah, H. Herken, A. D. Welch, eds., Springer-Verlag, pp. 48 (1970); J. A. Kanapka, I. R. Hamilton, *Arch. Biochem. Biophys.* 146, 167 (1971); L. Lebioda, et al., *Proteins* 16, 219 (1993); R. E. Marquis, *Can. J. Microbiol.* 41, 955 (1995)). The effects of this anion on bacterial growth have been proposed as one possible mechanism for the utility of fluoride-based oral hygiene products and fluoridated water (R. E. Marquis, *Can. J. Microbiol.* 41, 955 (1995); R. S. Levine, *Br. Dent. J.* 140, 9 (1976); H. Koo, *Adv. Dent. Res.* 20, 17 (2008); I. R. Hamilton, *J. Dent. Res.* 69, 660 (1990); C. Van Loveren, *Caries Res.* 35, 65 (2001)). Despite the demonstrated antibacterial action of fluoride and its proven utility for dental health maintenance, there is no understanding of the responses mounted by cells to combat fluoride toxicity. The discovery of a riboswitch class for fluoride reveals that many species sense intracellular fluoride levels and express specific genes to overcome the damaging effects of this anion.

2. Materials and Methods i. Reagents and Dinucleotides.

Carbon monoxide was obtained from Tech Air. The nucleotide derivatives 2,8-dihydroxyadenine, 8-hydroxyguanine, 8-hydroxyguanosine and 8-hydroxydeoxyguanosine were purchased from Cayman Chemical, as were spermine NONOate and DAF-2. Formaldehyde (37%) was purchased from J. T. Baker. All other reagents were obtained from Sigma-Aldrich unless otherwise stated. c-di-GMP, c-di-AMP and pApA were obtained from the BioLog Life Science Institute. ApG, GpG, GpA, pGpA and pApA containing the fluoride impurity were purchased from Oligos, Etc.

ii. DNA and RNA Oligonucleotides and Constructs.

Double-stranded DNAs were made by PCR using synthetic primers (Table 3) and template DNA from bacterial genomic samples or from synthetic DNAs. Synthetic oligonucleotides were obtained from Sigma-Aldrich or the W. M. Keck Foundation at Yale University. RNAs were prepared as describe in more detail below by in vitro transcription of PCR products using T7 RNA polymerase, and purified by using denaturing (8 M urea) 6% PAGE. Plasmid constructs were prepared by ligating PCR products to specific plasmids that had been pre-digested with appropriate restriction enzymes or by using a TOPO TA Cloning Kit (Invitrogen). Plasmids carrying mutant riboswitch sequences were prepared from the WT construct by using a QuickChange XL Site-directed Mutagenesis kit (Stratagene). Additional details on gene constructs are provided below.

TABLE 3

Sequences of DNA primers used in this study. The T7 RNA polymerase promoter is italicized, the lysine promoter is bolded, and any restriction sites are underlined

| | DNA sequence (5' to 3') | Use |
|---|---|---|
| SEQ ID NO: 1 | *taatacgactcactat*aggatcggcgcat tggagatggcattcc | Amplification of 78 Psy from *P. syringae* DC3000 genomic DNA |
| SEQ ID NO: 2 | caggtttctgtaggcatcatc | Amplification of 78 Psy from *P. syringae* DC3000 genomic DNA |
| SEQ ID NO: 3 | *taatacgactcactat*aggatcggcgcat tggag | In-line probing, WT 78 Psy |
| SEQ ID NO: 4 | caggtttctgtagggttcatcagctgctac ggg | In-line probing, M1 78 Psy |
| SEQ ID NO: 5 | cggcgcattggagatgggtttcctccatta acaaaccg | In-line probing, M2 78 Psy; Two-step PCR, Psy-pCR2.1, M2 |
| SEQ ID NO: 6 | cggtttgttaatggaggaaacccatctcca atgcgccg | In-line probing, M2 78 Psy; Two-step PCR, PsyM1-pCR2.1, M2 |
| SEQ ID NO: 7 | *taatacgactcactat*aggactaacaccc gtggaatggcgtttc | In-line probing, WT 74 Tvo |
| SEQ ID NO: 8 | cacccgtggaatggcgtttccactcgtaca aaccgccagctccag | In-line probing, WT 74 Tvo |
| SEQ ID NO: 9 | tttcaatcaggcgtcatcagtcagctggag ctggcggtttgtacg | In-line probing, WT 74 Tvo |
| SEQ ID NO: 10 | *taatacgactcactat*aggataacccaac gggcgatgaggcccgcccaa | In-line probing, WT 62 Tpe |

TABLE 3-continued

Sequences of DNA primers used in this study. The T7 RNA polymerase promoter is italicized, the lysine promoter is bolded, and any restriction sites are underlined

| | DNA sequence (5' to 3') | Use |
|---|---|---|
| SEQ ID NO: 11 | cagtagaggccatcagccctcttcagggc agtttgggcgggcctcatcg | In-ling probing, WT 62 Tpe |
| SEQ ID NO: 12 | *taatacgactcactata*ggatcggcgcat tggagccggcattcctccattaaca | In-line probing, M3 78 Psy; Two-step PCR, Psy-pCR2.1, M3 |
| SEQ ID NO: 13 | caggtttctgtgggcatcatcagctgctac gg | In-line probing, M4 78 Psy |
| SEQ ID NO: 14 | caggtttctgtacgcatcatcagctgctac ggg | In-line probing, M5 78 Psy |
| SEQ ID NO: 15 | caggtttctgtaggcatcatctgctgctacg ggcgcagcggttt | In-line probing, M6 78 Psy; Two-step PCR, Psy-pCR2.1, M6 |
| SEQ ID NO: 16 | *taatacgactcactata*ggatcggcgcat tgaagatggcattccttcattaacaaaccg ctgcgcc | In-line probing, M7 78 Psy |
| SEQ ID NO: 17 | gatggcattcctccattaacataccgctgc gcccgtagcagc | In-line probing, M8 78 Psy |
| SEQ ID NO: 18 | gctgctacgggcgcagcggtatgttaatg gaggaatgccatc | In-line probing, M8 78 Psy |
| SEQ ID NO: 19 | ggcattcctccattaacaatccgctgcgcc cgtagcagctg | In-line probing, M9 78 Psy |
| SEQ ID NO: 20 | cagctgctacgggcgcagcggattgttaa tggaggaatgcc | In-line probing, M9 78 Psy |
| SEQ ID NO: 21 | caggtttctgtaggcatcagcagctgctac gggcgcagcg | In-line probing, M10 78 Psy |
| SEQ ID NO: 22 | caggtttctgtaggcatcttcagctgctacg ggcgcagc | In-line probing, M11 78 Psy |
| SEQ ID NO: 23 | cattggagatggcattcctccactaacaaa ccgctgcgcccg | In-line probing, M12 78 Psy |
| SEQ ID NO: 24 | cgggcgcagcggtttgttagtggaggaat gccatctccaatg | In-line probing, M12 78 Psy |
| SEQ ID NO: 25 | ggagatggcattcctccattcacaaaccg ctgcgcccgtag | In-line probing, M13 78 Psy |
| SEQ ID NO: 26 | ctacgggcgcagcggtttgtgaatggag gaatgccatctcc | In-line probing, M13 78 Psy |
| SEQ ID NO: 27 | gatggcattcctccattaactaaccgctgc gcccgtagcag | In-line probing, M14 78 Psy |
| SEQ ID NO: 28 | ctgctacgggcgcagcggttagttaatgg aggaatgccatc | In-line probing, M14 78 Psy |
| SEQ ID NO: 29 | caggtttctgtaggcatcatcagctgctact ggcgcagcggtttgttaatgg | In-line probing, M15 78 Psy |
| SEQ ID NO: 30 | gcgcccgtagcagctgatgaaccctaca gaaacctgatcaaacc | Two-step PCR, Psy-pCR2.1, M1 |
| SEQ ID NO: 31 | ggtttgatcaggtttctgtagggttcatcag ctgctacgggcgc | Two-step PCR, Psy-pCR2.1, M1 |
| SEQ ID NO: 32 | gctaagatcggcgcattggagccggcatt cctccattaacaaacc | Two-step PCR, Psy-pCR2.1, M3 |
| SEQ ID NO: 33 | ggtttgttaatggaggaatgccggctccaa tgcgccgatcttagc | Two-step PCR, Psy-pCR2.1, M3 |
| SEQ ID NO: 34 | ccgtagcagctgatgatgcccacagaaa cctgatcaaaccagg | Two-step PCR, Psy-pCR2.1, M4 |

TABLE 3-continued

Sequences of DNA primers used in this study. The T7 RNA polymerase promoter is italicized, the lysine promoter is bolded, and any restriction sites are underlined

| | DNA sequence (5' to 3') | Use |
|---|---|---|
| SEQ ID NO: 35 | cctggtttgatcaggtttctgtgggcatcat cagctgctacgg | Two-step PCR, Psy-pCR2.1, M4 |
| SEQ ID NO: 36 | aaaccgctgcgcccgtagcagcagatga tgcctacagaaacctg | Two-step PCR, Psy-pCR2.1, M6 |
| SEQ ID NO: 37 | cattcctccattaacaaaccggagcgccc gtagcagctgatgatg | Two-step PCR, Psy-pCR2.1, M16 |
| SEQ ID NO: 38 | catcatcagctgctacgggcgctccggttt gttaatggaggaatg | Two-step PCR, Psy-pCR2.1, M16 |
| SEQ ID NO: 39 | caaaccggagcgcccgtagctcctgatg atgcctacagaaac | Two-step PCR, PsyM16-pCR2.1, M17 |
| SEQ ID NO: 40 | gtttctgtaggcatcatcaggagctacggg cgctccggtttg | Two-step PCR, PsyM16-pCR2.1, M17 |
| SEQ ID NO: 41 | aag<u>gaattc</u>aaaaataatgttgtcctttt aaataagatctgataaaatgtgaacta aatgtaataattataggcgatggagttcg | Amplification of *B. cereus* ATCC10987 *crcB* motif and expression platform |
| SEQ ID NO: 42 | aa<u>ggatcc</u>cctctttaaatagcttgctcaaa aaaatagactcct | Amplification of *B. cereus* ATCC10987 *crcB* motif and expression platform |
| SEQ ID NO: 43 | atgc<u>gaattc</u>tttggccctctttcgtaagcg gtga | Cloning of the *eriCF* gene from *P. syringae* DC3000 into pRS414 (full length and fusion to *lacZ* gene) |
| SEQ ID NO: 44 | gac<u>gggatcc</u>ccaggtcgtcgaaatttag acatttggcc | Cloning of the *eriC$^F$* gene from *P. syringae* DC3000 into pRS414 to form an in frame fusion to the *lacZ* gene around the $8^{th}$ codon |
| SEQ ID NO: 45 | gcga<u>aagctt</u>tcatttctcttcccccgcaag agtc | Cloning of the full length *eriCF* gene from *P. syringae* DC3000 into pRS414 |
| SEQ ID NO: 46 | ccgcttaatcagcgggtttttttggtcttta gtgtgcggttgaggccga | Verifying the deletion of the *crcB* gene in *E. coli* |
| SEQ ID NO: 47 | cggcgttacacttatcactcatacaaatcaa atagcaggattttgcagtg | Verifying the deletion of the *crcB* gene in *E. coli* | iii. Preparation of RNA Oligonucleotides.

To generate in vitro transcribed RNA, DNA templates were made by PCR amplification of wild-type plasmid or genomic DNA with the appropriate primers. All primers used to generate wild-type and mutant DNAs are found in Table 3. Transcription was carried out using bacteriophage T7 RNA polymerase (T7 RNAP) in 80 mM N-(2-hydroxyethyl)piperazine-N'-(2-ethanesulfonic acid) (HEPES) (pH 7.5 at 25° C.), 40 mM dithiothreitol (DTT), 24 mM $MgCl_2$, 2 mM spermidine, and 2 mM of each nucleoside 5'-triphosphate (NTP). RNA was purified using denaturing (8 M urea) 6% PAGE. The appropriately sized band was excised and the RNA was eluted from the crushed gel slice using 10 mM Tris-HCl (pH 7.5 at 23° C.), 200 mM NaCl, and 1 mM EDTA (pH 8.0). The RNA was subsequently precipitated with ethanol and pelleted by centrifugation.

To generate 5' $^{32}P$-labeled RNAs, the 5'-terminal phosphate was removed using alkaline phosphatase (Roche Diagnostics) following the manufacturer's protocol. The RNAs were then radiolabeled with [$\gamma$-$^{32}P$]ATP (Perkin Elmer) using T4 polynucleotide kinase (New England Biolabs). The 5' $^{32}P$-labeled RNAs were isolated and purified using the same protocol as described above.

iv. In-Line Probing.

The majority of in-line probing experiments were conducted as previously described (E. E. Regulski, R. R. Breaker, *Methods Mol. Biol.* 419, 53 (2008); E. R. Lee, et al., *Science* 329, 845 (2010)). Briefly, in vitro transcribed RNA were 5' $^{32}P$-radiolabeled and trace amounts (~1 nM) were incubated at room temperature for 48 hours (unless otherwise indicated) in the presence of 100 mM KCl, 50 mM Tris-HCl (pH 8.3 at 23° C.), and 20 mM $MgCl_2$. Cleavage products were separated by using denaturing 10% PAGE and imaged with a PhosphorImager (Molecular Dynamics). ImageQuant 5.1 was used to establish band intensities. Exceptions to the typical in-line probing methods are detailed in the following sections. Apparent $K_D$ values were determined by varying the amount of ligand in a series of in-line probing reactions and determining the concentration required to cause 50% modulation of spontaneous cleavage.

v. In-Line Probing at Elevated pH.

To test for possible binding of hydroxide ion, the buffer used for in-line probing included 100 mM KCl, 20 mM MgCl$_2$, and 50 mM CHES (pH 9.0, 9.3, 9.7, or 10.0 at 23° C.). Reactions were incubated in this buffer at room temperature for 5 hours and cleavage products were analyzed as described above.

vi. In-Line Probing with Formaldehyde.

To test for possible binding of formaldehyde, HEPES was used in the in-line buffer instead of Tris (50 mM HEPES, pH 8.3 at 23° C.) to prevent reactions between Tris and formaldehyde. A 37% formaldehyde solution (J. T. Baker) was used to make 10× formaldehyde stocks for addition to each In-line probing reaction. Reactions and analyses were otherwise conducted as usual.

An indicator, Schiff reagent for aldehyde detection, was used to establish that a substantial amount of formaldehyde was left in solution after two days (minimal evaporation occurred). Mock in-line probing reactions containing varying concentrations of formaldehyde were prepared in duplicate. To one set, 1 µL, of the Schiff reagent for aldehydes was added at time zero. The same was done to the other set after two days. The pink color was similar for the two sets, indicating that a similar amount of formaldehyde was present.

vii. In-Line Probing with the Gases CO and NO.

To test binding of CO gas with the 78 Psy RNA, a variation of the typical in-line probing reaction conditions at pH 9.7 was used. 5' $^{32}$P-labeled RNA was incubated at room temperature for three hours (possible due to the elevated pH) and analyzed as usual. A side-arm flask was capped with a rubber septum and the side-arm was covered with a Kim-Wipe to allow pressure to be released from the system. Carbon monoxide was bubbled through deionized water for 30 minutes before adding this water to the in-line probing reaction. Uncapped 1.5 mL micrifuge tubes containing the in-line probing reactions were placed in the side-arm flask. Carbon monoxide was streamed into the flask at 3 psi for 3 hours. In-line probing reaction products were analyzed as usual.

To test NO, spermine NONOate, a compound known to breakdown into nitric oxide at low pH, was used. Spermine NONOate (Cayman Chemical) was dissolved in 100 mM NaOH immediately before addition to an otherwise typical in-line probing reaction. Dilutions made to the stock solution were made with 100 mM NaOH. In-line probing reactions were carried out using the typical protocol, and the amount of NaOH delivered when adding spermine NONOate did not alter the pH substantially. The colorimetric indicator DAF-2 (Cayman Chemical) was used to monitor NO concentrations. Mock in-line probing reactions containing varying amounts of spermine NONOate were prepared in duplicate, and 1 µL of a DAF-2 solution (1.4 mM in DMSO) was added to each of the tubes in the dilution series either at time zero or after two days. For given concentrations of spermine NONOate, the extents of the color change in duplicate samples were similar, indicating that the levels of dissolved NO did not change significantly over the two day period.

viii. In-Line Probing with Calcium Chloride.

To confirm that fluoride was the ligand causing RNA structure modulation, in-line probing reactions were conducted in the presence of calcium chloride. Two stock solutions were made, one containing only 100 µM NaF, and the other containing 100 µM NaF and 1 mM CaCl$_2$. In-line probing reactions were conducted as usual with some reactions lacking additives (NR, no ligand) and others carrying fluoride (NaF) or fluoride plus calcium (NaF+CaCl$_2$). After two days, the same NaF and NaF+CaCl$_2$ stock solutions were used to set up a new set of NaF and NaF+CaCl$_2$ in-line probing reactions. The second set of reactions allowed for pre-equilibration of the fluoride and calcium before adding it to the RNA/in-line probing buffer mix. The reaction products were analyzed as usual.

ix. Bacterial Strains and Culture Conditions.

*Bacillus subtilis* 168 (trpC2), *Bacillus cereus* ATCC10987 and the *B. subtilis* integration vector pDG1661 were obtained from the *Bacillus* Genetic Stock Center (The Ohio State University). *E. coli* strain BW25113 and its various isogenic derivatives including BW25113 ΔcrcB (kan$^r$) were obtained from the *Coli* Genetic Stock Center (Yale University). Reporter vector pRS414 was a gift from R. W. Simons (UCLA). When required, growth medium was supplemented with antibiotics at the following concentrations: carbenicillin, 100 µg mL$^{-1}$; kanamycin, 30 µg mL$^{-1}$; chloramphenicol, 5 µg mL$^{-1}$. To study growth at low pH, LBK medium with appropriate buffer was used as described previously (L. M. Stancik, et al., *J. Bacteriol.* 15, 4246 (2002)).

x. Cell Growth and Reporter Assays.

Cell growth of WT and crcB KO *E. coli* strains were measured overnight using a Bioscreen C instrument (Oy Growth Curves Ab Ltd, Finland). The amount of fluoride added to the media was varied to measure the effect on growth at several pH values. Reporter constructs with *B. cereus* or *P. syringae* riboswitch sequences fused to the lacZ gene were cloned into the vectors pDG1661 or pRS414, respectively. The two vectors were transformed into *B. subtilis* or *E. coli*, and gene expression was examined by addition of X-gal into grown cultures or quantified with Miller assays.

xi. Reporter Gene Constructs.

Nucleotides −110 to +1 with respect to the translation start site of the crcB gene encompassing the fluoride sensing aptamer and the downstream expression platform from *B. cereus* (ATCC10987) genomic DNA was amplified by PCR as an EcoRI-BamHI fragment and cloned into the vector pDG1661 to yield a transcriptional fusion with a promoter-less lacZ gene. The amplified fragment also integrated (via primer) a previously characterized lysine promoter from *B. subtilis* (N. Sudarsan, et al., *Genes Dev.* 21, 2688 (2003)) to drive expression (primers are listed in Table 3). The resulting construct was integrated into the amyE locus of *B. subtilis* as described previously (N. Sudarsan, et al., *Genes Dev.* 21, 2688 (2003)).

The 5' UTR of COG0038 (eriC$^F$ homolog) was amplified from *P. syringae* DC3000 genomic DNA as an EcoRI-BamHI fragment and cloned into the translational reporter vector pRS414. Its gene control function in *E. coli* was established using methods similar to those previously described (A. Nahvi, et al., *Chem. Biol.* 9, 1043 (2002)). Specifically, the region encompassing nucleotides −248 to +24 with respect to the beginning of the eriC$^F$ ORF was cloned as a translational fusion in pRS414, wherein the 8$^{th}$ codon of the ORF was fused in frame to the 9$^{th}$ codon of lacZ reporter gene. Mutations in the regulatory region were generated by a three-step PCR approach using methods described previously (A. Nahvi, et al., *Chem. Biol.* 9, 1043 (2002)).

xii. Complementation with eriC$^F$ Gene from *P. syringae*.

The eriC$^F$ gene from *P. syringae* DC3000 was amplified from genomic DNA by PCR and cloned into the pCR2.1 TA vector (Invitrogen). The cloned fragment contained the full length eriC$^F$ ORF, the 5' UTR features described above, and the native promoter to drive expression.

xiii. Growth Curves

For each bacterial strain, an overnight culture was set up of the desired bacteria the previous day. The majority of the growth curves were conducted in 350 µL LB medium that initially was not supplemented with salt. 2× LB without salt addition was prepared by combining 10 g Bacto tryptone (pancreatic digest of casein), 5 g Bacto yeast extract, deionized water to 500 mL, and 2 mL 1 N sodium hydroxide (mixture subsequently autoclaved). The desired concentration of NaF or NaCl was subsequently added as designated for each culture after a 1:100 dilution of an overnight culture. Wells with NaF concentrations below 1 mM were supplemented with 1 mM NaCl. Each condition was set up in duplicate or triplicate. Every fifteen minutes the 100-well plate was shaken at medium intensity for 10 seconds and the $OD_{600}$ was automatically measured for a period of 16 hours. The data was analyzed using Microsoft Excel.

Growth curves to compare pH conditions used 350 µL of LB (neutral pH) or LBK medium (pH 5.5), 3.5 µL of an overnight culture, and 3.5 µL, of a 10× sodium fluoride or sodium chloride solution. Growth curves with empty or $eriC^F$-containing plasmid included 100 µg mL$^{-1}$ carbenicillin added to the growth medium (2XLB), which was subsequently diluted two-fold to a final concentration of 50 µg mL$^{-1}$.

xiv. Expression Analysis of Fluoride Riboswitch-Reporter Fusion Constructs.

A single colony of *Bacillus subtilis* harboring the crcB riboswitch reporter construct was grown overnight in LB with chloramphenicol. The next day, it was subcultured by diluting to 1/200$^{th}$ using a defined glucose glutamate medium with chloramphenicol. The concentrations of added NaF in the medium varied from zero to 30 mM. β-galactosidase reporter gene expression was evaluated by adding X-gal (400 µg mL$^{-1}$).

*E. coli* strains BW25113 and its crcB KO derivative strain harboring the $eriC^F$ riboswitch reporter construct were streaked on modified LB plates with carbenicillin (100 µg mL$^{-1}$) and X-gal (800 µg ml$^{-1}$). Plates included 0, 0.2 or 50 mM NaF. Modified LB included 10 mM NaCl. Miller assays for reporter gene expression were conducted in 96-well format as described previously (N. Sudarsan, et al., *Science* 5797, 300 (2006)).

xv. *E. coli* Knock Out Strains and Fluoride Sensitivity.

Knock out strains (Coli Genetic Stock Center—Yale University) ΔclcA, ΔclcB, Δpgi, Δpgm, Δppx and Δppk were evaluated for fluoride sensitivity in LB with 50 mM NaF. The chloride transporter knock outs (ΔclcA and ΔclcB) are eriC homologs and were tested to determine whether they affect fluoride toxicity compared to the $eriC^F$ from *P. syringae* and the endogenous crcB. Neither of the eriC homolog KO strains exhibited reporter activity at low fluoride concentrations, unlike ΔcrcB. Since fluoride is known to inhibit enolase, phosphogluco isomerase (Δpgi) and phosphogluco mutase (Δpgm) were knocked out to see if glycolytic intermediates in their respective metabolic pathways might have an effect on the reporter. Again, these KO strains were not unusually sensitive to high fluoride concentration and reporter gene expression was not triggered at low fluoride concentrations. Finally, since overproduction of CrcB has been associated with chromosome condensation (K. H. Hu, et al., *Genetics* 143, 1521 (1996)), knock outs of two genes known to control chromosome condensation (polyphosphate and polyphosphate kinase, Δppx and Δppk), were tested. Neither KO strain exhibits reporter gene activation at low fluoride concentrations.

xvi. Nucleic Acid Sequence Databases

Analysis was performed on sequences from the bacterial and archaeal subsets of version 44 of the RefSeq database (K. D. Pruitt, et al., *Nucleic Acids Res.* 35, D61 (2007)), as well as environmental metagenome sequences from acid mine drainage (G. W. Tyson, et al., *Nature* 428, 37 (2004)), air (S. G. Tringe, et al., *PLoS One* 3, e1862 (2008)), Global Ocean Survey scaffolds (D. B. Rusch, et al., *PLoS Biol.* 5, e77 (2007); J. C. Venter, et al., *Science* 304, 66 (2004)), ground water (C. L. Hemme, et al., *Isme J.* 4, 660 (2010)), gutless sea worms (T. Woyke, et al., *Nature* 443, 950 (2006)), hot springs (W. P. Inskeep, et al., *PLoS One* 5, e9773 (2010)), human gut (S. R. Gill, et al., *Science* 312, 1355 (2006); K. Kurokawa, et al., *DNA Res.* 14, 169 (2007); J. Qin, et al., *Nature* 464, 59 (2010)), hydrothermal vent (W. J. Brazelton, J. A. Baross, *Isme J.* 3, 1420 (2009)), kimchi (J. Y. Jung, et al., *Appl. Environ. Microbiol.* 77, 2264 (2011)), lake sediment (M. G. Kalyuzhnaya, et al., *Nat. Biotechnol.* 26, 1029 (2008)), marine sequences (K. T. Konstantinidis, et al., *Appl. Environ. Microbiol.* 75, 5345 (2009); E. A. Dinsdale, et al., *PLoS One* 3, e1584 (2008)), mouse gut (P. J. Turnbaugh, et al., *Nature* 444, 1027 (2006)), sludge (H. Garcia Martin, et al., *Nat. Biotechnol.* 24, 1263 (2006)), soil (S. G. Tringe, et al., *Science* 308, 554 (2005)), termite hindgut (F. Warnecke, et al., *Nature* 450, 560 (2007)), wallaby gut (P. B. Pope, et al., *Proc. Natl. Acad. Sci. USA* 107, 14793 (2010)), whalefall (S. G. Tringe, et al., *Science* 308, 554 (2005)) and others (E. A. Dinsdale, et al., *Nature* 452, 629 (2008)). These and other environmental sequences were identified and downloaded from the GenBank (D. A. Benson, et al., *Nucleic Acids Res.* 36, D25 (2008)), IMG/M (D. A. Benson, et al., *Nucleic Acids Res.* 36, D25 (2008)), CAMERA (S. Sun, et al., *Nucleic Acids Res.* 39, D546 (2011)) or MG-RAST (F. Meyer, et al., *BMC Bioinformatics* 9, 386 (2008)) web sites, or from sources specific to the publication (J. Qin, et al., *Nature* 464, 59 (2010)). Where available, protein-coding genes were extracted from the annotation downloaded with the sequences, or predicted using MetaGene (H. Noguchi, et al., *Nucleic Acids Res.* 34, 5623 (2006)), as described previously (Z. Weinberg, et al., *Genome Biol.* 11, R31 (2010)). Conserved protein domains were predicted using the Conserved Domain Database version 2.25 (A. Marchler-Bauer, et al., *Nucleic Acids Res.* 39, D225 (2011)). When two predicted domains overlapped, the prediction with the better E-value was used, except that "specific hits" (A. Marchler-Bauer, et al., *Nucleic Acids Res.* 39, D225 (2011)) were always selected over other hits regardless of relative E-values.

xvii. Homology Search for Fluoride Riboswitches

Homology searches were conducted using the cmsearch program from the Infernal software package (E. P. Nawrocki, et al., *Bioinformatics* 25, 1335 (2009)). A multiple-sequence alignment of the RNAs was edited using the RALEE (S. Griffiths-Jones, *Bioinformatics* 21, 257 (2005)) extension to the Emacs text editor. Searches were performed iteratively, initially using the previously established alignment of the crcB RNA motif (Weinberg, et al., *Genome Biol.* 11, R31 (2010)). A previously described search strategy was applied (Z. Weinberg, et al., *Nucleic Acids Res.* 35, 4809 (2007)) wherein some searches were performed on sequences within 2 Kb upstream of genes commonly associated with fluoride riboswitches.

Because the high diversity of sequences within the relatively small RNA might blur sequence conservation in related sequences, we performed some additional search strategies. First, fluoride riboswitches present in the RefSeq database were partitioned by their phyla according to RefSeq, and these alignment partitions were used as separate queries with the cmsearch program. Second, fluoride riboswitches were partitioned into separate alignments using the CD-HIT program (W. Li, A. Godzik, *Bioinformatics* 22, 1658 (2006)) with threshold 0.6, and searched separately. Third, all known fluoride riboswitches were used as queries in a nucleotide BLAST (S. F. Altschul, et al., *Nucleic Acids Res.* 25, 3389 (1997)) search. These three search strategies increased the number of known fluoride riboswitches by less than 10%, but did help to fully uncover previously undetected fluoride riboswitches in the genus *Streptomyces*. The BLAST searches helped to find truncated fluoride riboswitches, or sequences similar to borderline fluoride riboswitch matches. In some cases these latter sequences matched the consensus very poorly and revealed that the borderline matches were probably false positives. The RNA consensus diagram was initially drawn using R2R (Z. Weinberg, R. R. Breaker, *BMC Bioinformatics* 12, 3 (2011)) based on the alignment resulting from all searches.

xviii. Genes Regulated by Fluoride Riboswitches

One or more consecutive genes were predicted to reside in an operon regulated by a fluoride riboswitch when the first gene is found within 700 base pairs of the fluoride aptamer, all genes are transcribed in the same direction as the aptamer and the maximum distance between the genes is 100 base pairs. Protein domains predicted to be encoded by these genes were identified as above. Genes encoded on the opposite strand to the riboswitch were never counted, even though there is precedent for such genes to be regulated by riboswitches (G. André, et al., *Nucleic Acids Res.* 36, 5955 (2008)).

Figures 4A, 4B:
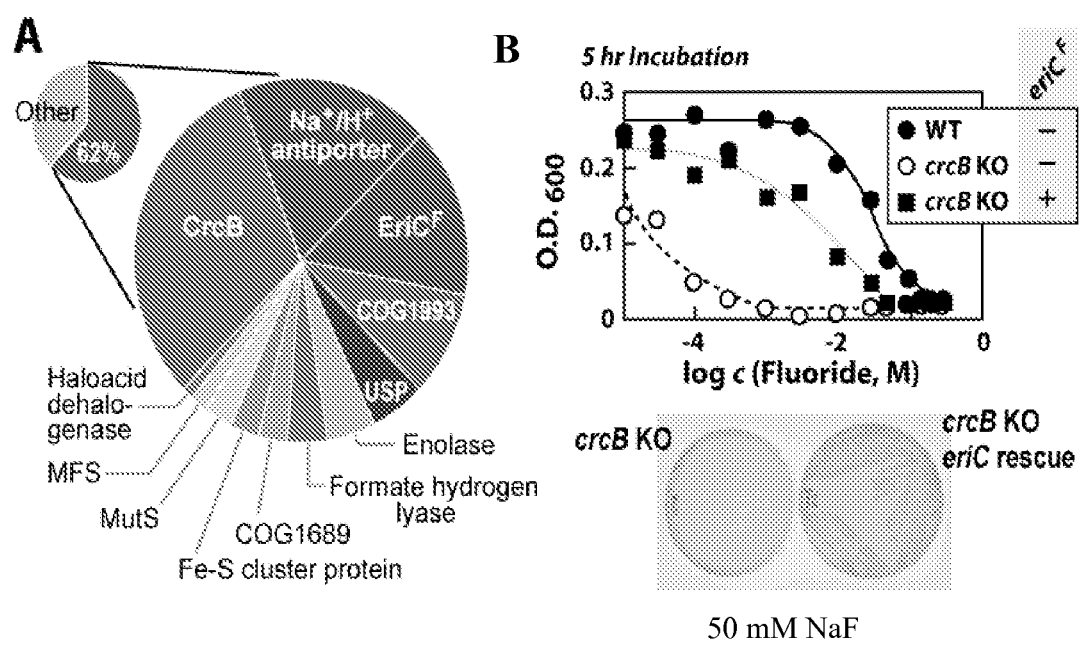
FIGS. 4A and 4B show genes associated with fluoride riboswitches and the unique characteristics of an EriC protein subclass. (A) Genes most commonly associated with fluoride riboswitches in bacteria and archaea as classified by the Conserved Domain Database (A. Marchler-Bauer, et al. Nucleic Acids Res. 39:D225 (2011)). 62% fall into twelve common categories as noted with sections proportional to the number of operons encoding the specified protein. MFS: major facilitator superfamily; USP: universal stress protein. (B) Rescue of *E. coli* crcB KO cells from extreme fluoride toxicity in liquid (top) or on solid (bottom) media by transformation with the eriC$^F$ gene from *P. syringae*. Annotations are as described in Table 5.
Figure 12:
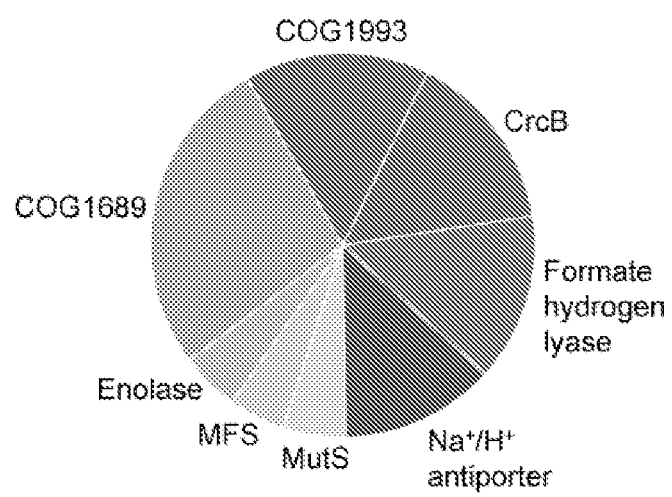
FIG. 12 is a pie chart showing the genes associated with fluoride riboswitches in archaeal species. Annotations are as described in Table 5.
Figure 13A:
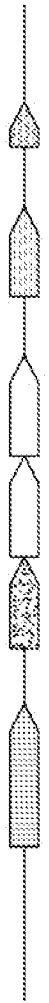
FIGS. 13A and 13B show diagrams of crcB and eriC$^F$ genes in *Streptococcus*. (A) Distinct gene arrangements surrounding all crcB and eriC$^F$ genes in sequenced *Streptococcus* species. "#": number of organisms with this arrangement, "Example strain": one of the organisms. Gene classes are identified by the specific marked arrows (see B). Corresponding regions harboring transposases and one partial sequence fragment are ignored. Lengths of genes and gaps are not to scale, as exact distances vary per organism. However, the first eriC$^F$ gene in *S. agalactiae* is unusually small, as shown. A tRNA(Arg) is located roughly 3,000 base pairs downstream of the depicted region in *S. mutans*. As the diagram shows, all sequenced *Streptococcus* species have either a crcB or an eriC$^F$ gene (but never both) flanked by highly similar gene arrangements. (B) Codes of gene families used in A.
Figure 13B:
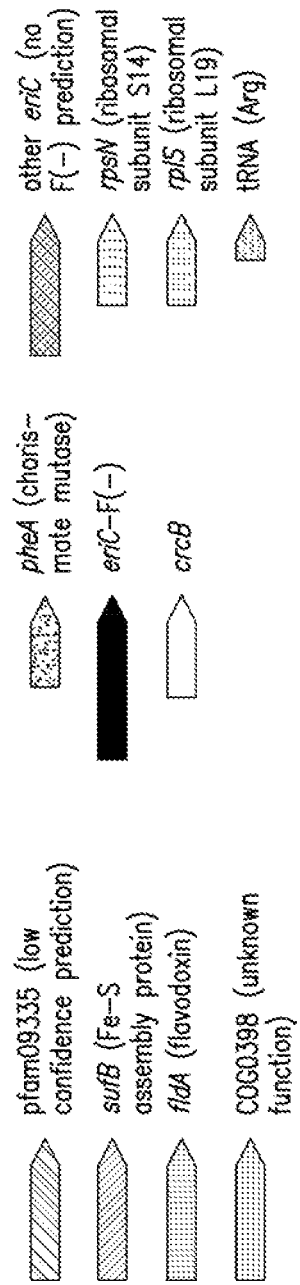

In FIG. 4A and FIG. 12, the numbers of operons containing one or more of gene encoding domains in the relevant category were used; this definition avoids overcounting categories present in multiple genes within the same operon (e.g., formate hydrogen lyase). When many closely related organisms are sequenced, genes regulated in these organisms can be overrepresented. For example, 31 inositol monophosphatase genes are regulated by fluoride riboswitches, but these genes are present only in strains of *Enterococcus faecalis* as the third gene in predicted operons, and thus are not likely to be significant. To reduce the impact of these effects, operons were weighted based on the uniqueness of the fluoride riboswitch predicted to regulate them. These weights were derived by applying the GSC algorithm (M. Gerstein, et al., *J. Mol. Biol.* 236, 1067 (1994)) as implemented in the Infernal software package (E. P. Nawrocki, et al., *Bioinformatics* 25, 1335 (2009)) to the alignment of fluoride riboswitch aptamers. Gene categories were ignored when they occurred in fewer than 1% of operons, using weighted frequencies. For the small pie chart in the upper, left corner of FIG. 4A, weighted frequencies were also used, but genes were counted individually (i.e., not considered in the context of operons).

Among genes predicted to be regulated by fluoride riboswitches, some correlations were noticed. "Ni/Fe-hydrogenase III" and "radical SAM" domains are always encoded in operons that also encode formate hydrogen lyase genes, so we grouped these proteins together. The "class II terpene cyclase-like" domain (Conserved Domain Database accession cd00688) were grouped under the "COG1689" category, since all terpene cyclase-like proteins regulated by the fluoride riboswitch also matched the COG1689 domain, but the reverse was not always true. The presence of a gene encoding COG1993 is highly correlated with the occurrence of another gene in the operon encoding CrcB or EriC$^F$ proteins. When weighted by the GSC algorithm as above, 80% of COG1993 genes are predicted as cotranscribed with a crcB gene, and 8% of operons with COG1993 genes also have eriC$^F$ genes. However, COG1993 was continued to be treated separately from other domains, because it is correlated with multiple rather than a single other domain. Similarly, the "haloacid dehalogenase" and "universal stress protein" domains were also highly correlated with other domains, with 10% or fewer of these proteins appearing in an operon in the absence of genes from one of the other 11 most common categories.

Each category in the pie chart (FIG. 4A) was defined as the union of certain accessions in the Conserved Domain Database (Table 5).

TABLE 5

Table showing the accessions in the conserved domain database

| Category name | Conserved Domain Database accessions |
| --- | --- |
| COG1689 | cd00688, COG1689 |
| COG1993 | COG1993, pfam02641 |
| CrcB | COG0239, PRK14195, PRK14196, PRK14202, PRK14215, PRK14228, TIGR00494 |
| Enolase | cd03313, pfam03952, PTZ00081 |
| EriC | cd00400, cd03682 |
| Fe—S cluster (E.g. NifU) | COG0822, COG1142, TIGR03652 |
| Formate hydrogen lyase (Includes Ni/Fe-hydrogenase III and Radical SAM) | cd01335, COG0650, COG0651, COG1143, COG3260, COG3261, COG3262, COG4237, pfam00329, PRK06459 |
| Haloacid dehalogenase (Full CDD name: "haloacid dehalogenase-like hydrolase") | cd01427, pfam08282 |
| Major Facilitator Superfamily | cd06174, pfam07690 |
| MutS (Note: might only correspond to the ATPase domain of MutS; this is the only domain matched when proteins are searched against Pfam) | cd03243, cd03283, COG0249 |
| Na$^+$/H$^+$ antiporter (Note: includes K$^+$/H$^+$ antiporters) | COG0025, COG0475, pfam00999, TIGR00932 |
| Universal Stress Protein | cd00293, pfam00582 |

Rho-independent transcription terminators were predicted using RNIE (Gardner et al., *Nucleic Acids Res.*, 39: 5845-5852 (2011)).

xix. Analysis of EriC Proteins

Initial analysis was conducted using the previously published alignment of crcB RNAs (Weinberg et al., *Genome Biol.* 11, R31 (2010)) restricted to sequences in RefSeq version 32. Genes predicted to be regulated by these fluoride riboswitches were extracted as above. Those genes predicted to belong to the EriC model in version 2.08 of the Conserved Domain Database were identified, and their protein sequences were retrieved. This was called the "positive set". Other eriC genes found within the same organisms as those in the positive set were extracted with their protein sequences; these formed the "negative set". All protein sequences were aligned to the Pfam 23.0 model PF00654 (Finn, et al., *Nucleic Acids Res.* 38, D211 (2010)) using the HMMER version 3.0 (http://hmmer.janelia.org) program hmmsearch. The positive and negative set proteins were manually compared, and numerous differences were observed, the most noticeable of which corresponded to certain residues in the previously established selectivity filter (Dutzler, et al., *Nature* 415, 287 (2002)). One fluoride riboswitch-associated protein (out of 103 proteins) did not have the typical sequence features and was removed from the positive set. Also, one protein in the negative set out of 263 was similar in sequence to the positive set and was removed.

The positive set proteins were then used to search the proteins in RefSeq version 44 and metagenome sequences. The HMM from the Pfam version 24.0 model PF00654 was also used to search this protein database using the hmmsearch program with the score cutoff encoded by Pfam, and proteins scoring below this cutoff were discarded from further analysis. To classify proteins that are similar to the positive set, whether or not they are associated with an RNA, the hmmsearch score obtained in the PF00654 search was subtracted from the hmmsearch score obtained in the positive set search. This defines the "heuristic subfamily score". Proteins with scores greater than zero favor classification as fluoride transporters. (However, the heuristic subfamily score is not a true LOD score because the null model probabilities in each hmmsearch score are not necessarily equal.) Virtually all EriC proteins associated with fluoride riboswitches have the sequences GREGT (SEQ ID NO:48) or GREGV (SEQ ID NO:49) and GXVXP in their selectivity filter, where X represents any amino acid. (Among proteins whose genes are in completely sequenced genomes, 68 out of 70 have these features.) Identified fluoride transporters that lacked these sequence features or that appeared to be truncated on their N- or C-termini were removed. These defined a higher confidence set of fluoride transporters. Sequences were automatically aligned to the earlier model using hmmsearch.

The alignment of proteins matching the PF00654 model of EriC generated by hmmsearch (see above) were used to generate a phylogenetic tree. Only proteins in completed genome sequences were considered further, since prediction of riboswitch regulation might be difficult in incomplete or environmental sequence. However, the phylogenetic analysis described below with all proteins clustered to 60% identity was done, and similar results were obtained.

Protein sequences were eliminated if they had more than 15 consecutive gaps on their N-terminus or 6 consecutive gaps on their C-terminus. These numbers were chosen empirically based on which sequences were judged to be truncated, and the numbers might need to change if a different set of proteins were searched. Proteins can be truncated because they come from environmental sequence fragments, because of incorrect start codon predictions or because they do not fully match the computer's model. These proteins were clustered into sets that were 80% identical in sequence using CD-HIT (W. Li, A. Godzik, Bioinformatics 22, 1658 (2006)), and took one representative from each cluster. In the resulting alignment, columns that were more than 50% gaps were eliminated. A phylogenetic tree and branch significance using version "phyml-20100914" of PhyML (S. Guindon, O. Gascuel, Syst. Biol. 52, 696 (2003)) was inferred with the following command line: "phyml -i alignment.phylip --rand_start --n_rand_starts 10 -d aa -f e -t e -v e -a e -s SPR -o tlr --no_memory_check -b -4." The predicted tree was drawn using the Interactive Tree of Life web site (S. Guindon, O. Gascuel, Syst. Biol. 52, 696 (2003)). The branching confidence values are based on the likelihood ratio tests (M. Anisimova, O. Gascuel, Syst. Biol. 55, 539 (2006)) specified by the "-b -4" command-line option in PhyML.

In Table 4, selectivity filter residues in EriC$^F$ proteins were predicted based on the alignments produced by the hmmsearch program against the Pfam EriC model. However, the alignment of the five residues aligned to the sequence GSGIP in chloride transporters (channels) was shifted by 2 positions. This shift resulted in the aligning of five residues that were more highly conserved among EriC$^F$ proteins than those in the original alignment, and therefore more consistent with the constraints of a selectivity filter. Also, the Y445 position (R. Dutzler, et al., Nature 415, 287 (2002)) is not part of the Pfam model, but a longer alignment of EriC proteins led to the alignment of a tyrosine in EriC$^F$ proteins to this position. Biochemical or structural studies will be necessary to determine the correct alignment of selectivity filters in the EriC$^F$ proteins. However, any of the possible alignments lead to the conclusion that EriC$^F$ proteins have several distinct amino acids in the selectivity filter positions.

TABLE 4

Amino acid alignments of the conserved channel-forming residues of several EriC proteins reveal unique sequences among representatives associated with fluoride riboswitches (boxed) compared to those known to transport chloride. Experimentally confirmed (Cl$^-$, NO$_3^-$) or expected (F$^-$) substrates are indicated. Note that other alignments of residues are possible, but imply at least as many mismatches in the selectivity filter. Bold letters - conserved in Cl$^-$ transporters; Lower case letters - differ from Cl$^-$ transporters.

| Substrate | Organism | "Selectivity Filter Residues" | | | |
|---|---|---|---|---|---|
| Cl$^-$ | Human (ClC-1) | GSGIP (SEQ ID NO: 50) | GKEGP (SEQ ID NO: 51) | GGFMP (SEQ ID NO: 52) | Y |
| Cl$^-$ | Human (Cl-1) | GSGIP (SEQ ID NO: 50) | GKEGP (SEQ ID NO: 51) | GLFIP (SEQ ID NO: 53) | Y |
| Cl$^-$ | E. coli | GSGIP (SEQ ID NO: 50) | GREGP | GIFAP (SEQ ID NO: 54) | Y |
| NO$_3^-$ | Arabidopsis | GpGIP (SEQ ID NO: 54) | GKEGP (SEQ ID NO: 51) | GIFAP (SEQ ID NO: 54) | Y |
| F$^-$ | Pseudomonas syringae | Gnnli (SEQ ID NO: 57) | GREGt (SEQ ID NO: 48) | GEvTP (SEQ ID NO: 58) | Y |
| F$^-$ | Clostridium difficile | Gmnli (SEQ ID NO: 59) | GREGv (SEQ ID NO: 49) | GEvTP (SEQ ID NO: 58) | Y |
| F$^-$ | Streptococcus mutans | GmGli (SEQ ID NO: 60) | GREGv (SEQ ID NO: 49) | GEvTP (SEQ ID NO: 58) | Y | xx. Distribution of CrcB and EriC$^F$ Proteins and Fluoride Riboswitches

A previously established phylogenetic tree of the three domains (F. D. Ciccarelli, et al., Science 311, 1283 (2006)) was downloaded from the iTOL web site (I. Letunic, P. Bork, Bioinformatics 23, 127 (2007)). To analyze CrcB proteins, species names on the tree were compared to those in the Pfam database (R. D. Finn, et al., Nucleic Acids Res. 38, D211 (2010)). Strain designations were ignored because they were inconsistently named between the two datasets. Tree species that did not have a match in the Pfam entry for ribosomal protein S12 (Pfam accession PF00164) were assumed to be absent from or un-mappable to the underlying Pfam database, and were removed from the final tree image. Species matching a CrcB protein (Pfam accession PF02537) were marked appropriately.

EriC$^F$ proteins and fluoride riboswitches were predicted as described above within the RefSeq database. Species names were extracted from the RefSeq database, and matched with species on the phylogenetic tree, again ignoring strain designations. Tree species that did not match any species in the RefSeq database were removed from the tree.

These data were used to annotate the tree of life using the iTOL web site. The resulting tree image was downloaded from the web site, and edited manually. Branches were removed when their lengths were too short to be distinguished in the final figure.

xxi. High-Throughput Screening Protocol

A 110 mL culture volume of crcB K.O. and eriC$^F$ rescue E. coli cells harboring the riboswitch-reporter fusion construct are grown to stationary phase. Growth medium is Luria-Bertani (LB) containing carbenicillin at 50 μg mL$^{-1}$. 20,000 wells in microtiter-plate format are prepared with 45 μL LB supplemented with 50 μg mL$^{-1}$ carbenicillin, 0.5 mM sodium fluoride and X-gal. X-gal supplementation is not necessary if a GFP-based reporter is used. Individual compounds are distributed from a 20,000-member library (Maybridge Diversity) to each well prepared in Step#2 to a final concentration of 10 μM. The culture generated in Step #1 is diluted by $\frac{1}{10}^{th}$ by addition of a 5 μL aliquot to each of the wells prepared in Steps #2 and #3. Each well is incubated for four hours and evaluated for the emergence of blue color by analysis at $A_{475}$. Emergence of fluorescence with excitation at 395 nm and detection via A509 can be measured if a GFP reporter is used.

a. Controls

Each plate includes the following control wells: (i) WT E. coli lacking a riboswitch-reporter fusion construct (no signal), (ii) E. coli crcB K.O. cells with reporter plus 0.5 mM sodium fluoride (blue signal) (iii). E. coli crcB K.O. cells with eriC$^F$ rescue gene and reporter plus 0.5 mM sodium fluoride (no signal).

b. Post Screen Analysis

Initial hits are retested to confirm signal generation and hits will be grouped into potential pharmacophore and mechanistic classes.

c. Additional Screening

All 142,290 compounds in the chemical collections can be screened if the hit rate yields inadequate numbers of compounds in our initial run. In addition, other genes associated with fluoride toxicity resistance (priority is the eriC$^F$ subclass) can be cloned into the E. coli crcB K.O. strain to provide additional targets for compound screening.

3. Results i. Serendipitous Discovery of Fluoride Riboswitches.

A class of fluoride-responsive riboswitches were identified during the analysis of a group of noncoding RNAs collectively called the "crcB motif". This candidate riboswitch class initially was discovered during a bioinformatics search for novel RNAs in bacteria (Z. Weinberg, et al., Genome Biol. 11, R31 (2010)). Nearly 2200 representatives have been identified wherein each adopts either a two- (69%) or three-stem (31%) junction carrying more than a dozen highly-conserved nucleotides (FIG. 1A)

Frequently, crcB motif RNAs are located in the 5' untranslated regions (5' UTRs) of messenger RNAs for CrcB proteins, which have previously been implicated in chromosome condensation and camphor resistance (K. H. Hu, et al., Genetics 143, 1521 (1996)). Numerous other associated proteins are annotated as transporters (e.g. chloride, sodium, proton transport) or proteins whose functions are ascribed to various physiological (e.g. DNA repair, universal stress adaptation) or metabolic (e.g. enolase, formate-hydrogen lyase) processes. These gene associations led to search for binding of synthetic RNA dinucleotide analogs of the bacterial second messengers c-di-AMP (implicated in DNA repair) (G. Witte, et al., Mol. Cell 30, 167 (2008); U. Römling, Sci. Signal. 1, pe39 (2008)) and c-di-GMP (diverse gene associations) (N. Sudarsan, et al., Science 321, 411 (2008); E. R. Lee, et al., Science 329, 845 (2010)).

Figure 1B:
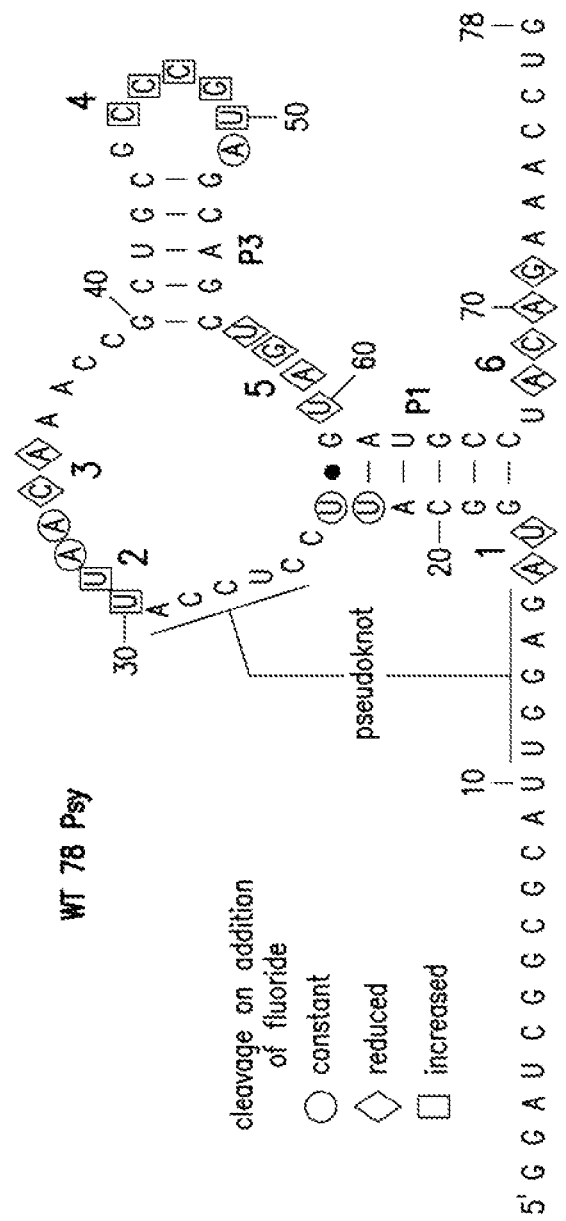

Conformational changes in riboswitch aptamers brought about by ligand binding were assessed by using a method called in-line probing (G. A. Soukup, R. R. Breaker, RNA 5, 1308 (1999); E. E. Regulski, R. R. Breaker, Methods Mol. Biol. 419, 67 (2008)). This method exploits the fact that unstructured RNA regions typically undergo spontaneous cleavage of phosphoester linkages faster than structured regions. Substantial conformational changes were observed when various synthetic dinucleotide samples were incubated with an RNA construct derived from the crcB gene of P. syringae (78 Psy; FIG. 1B; Table 3). However, it was eventually determined that the conformational changes were caused by fluoride ions. Tetra-n-butylammonium fluoride (TBAF) was used to remove the silyl-based protecting groups (F. Wincott, et al., Nucleic Acids Res. 23, 2677 (1995)) from the ribose 2' oxygens of the synthetic dinucleotides, and traces of fluoride remained in the commercial dinucleotide preparations.

Figure 1C:
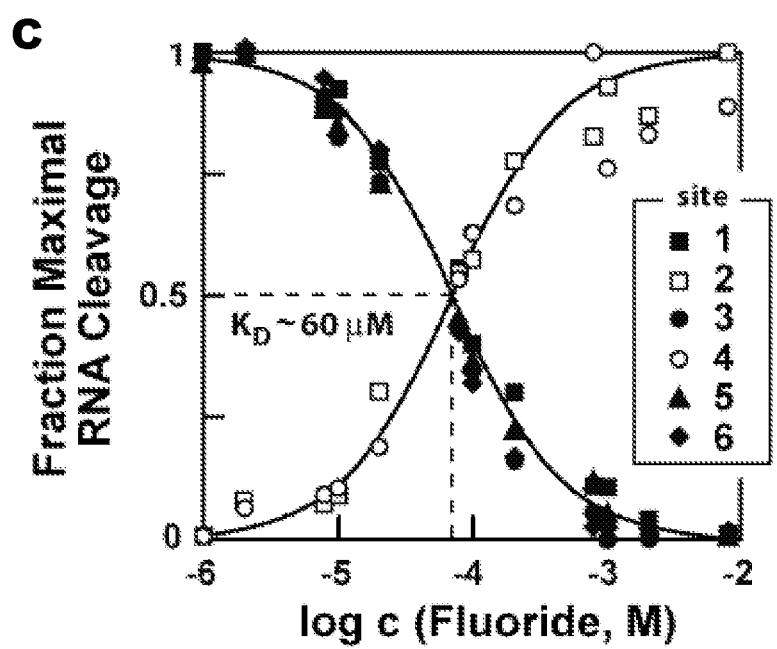
Figure 6A:
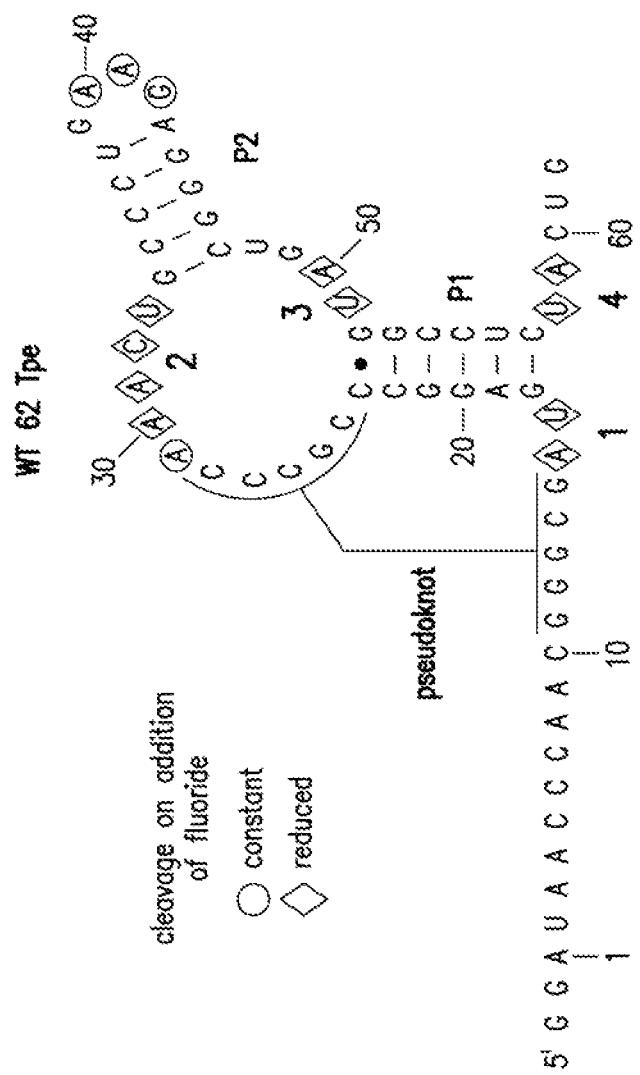
FIGS. 6A and 6B show the sequences and structures of crcB motif RNAs from *Thermotoga petrophila* and *Thermoplasma volcanium* incubated with sodium fluoride. (A) Sequence and secondary structure model for the *Thermotoga petrophila* crcB motif RNA (SEQ ID NO:350). (B) Sequence and secondary structure model for the *Thermoplasma volcanium* crcB motif RNA (SEQ ID NO:351). Other annotations are as described in the legend to FIG. 1A and FIG. 1B.
Figure 6B:
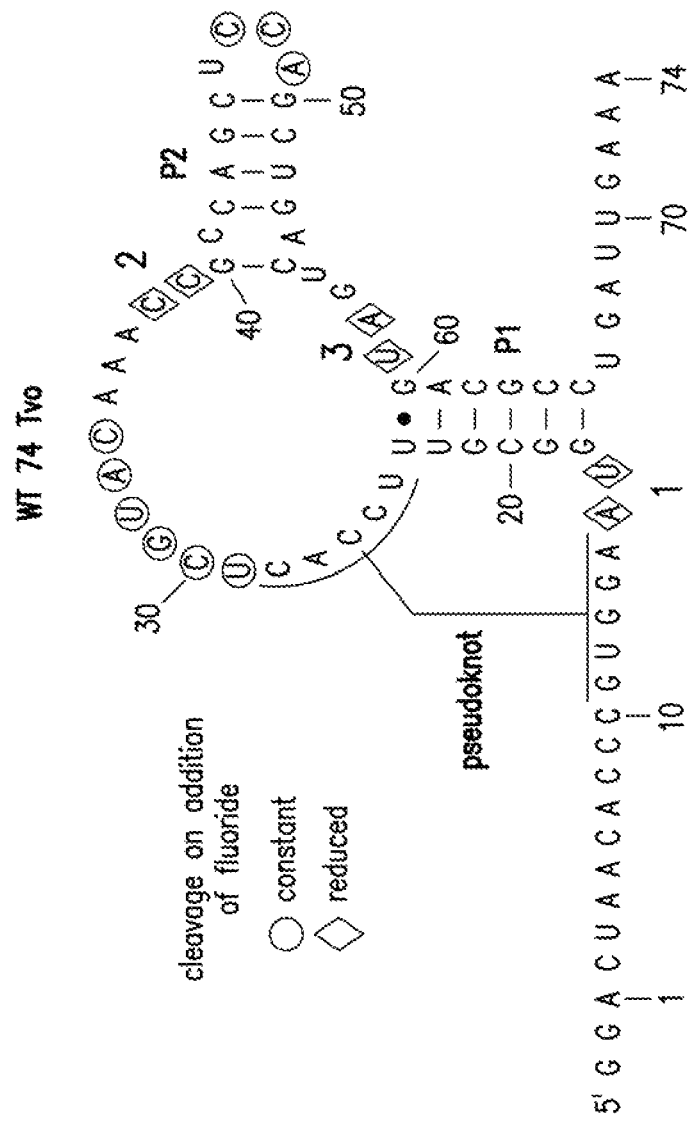

TBAF and other sources of free fluoride ions such as NaF, triethylamine trihydrofluoride, and potassium bifluoride all trigger identical conformational changes of 78 Psy crcB motif RNA. The in-line probing pattern is consistent with the formation of a one-to-one RNA/fluoride complex with an apparent dissociation constant ($K_D$) of approximately 60 μM (FIG. 1C). Similar $K_D$ values (~50 μM) for fluoride binding were obtained on analysis of two other crcB motif representatives from the bacterium Thermotoga petrophila and the archaeon Thermoplasma volcanium (FIG. 6), which demonstrates that distal homologs of this RNA class also respond to fluoride.

Figure 7:
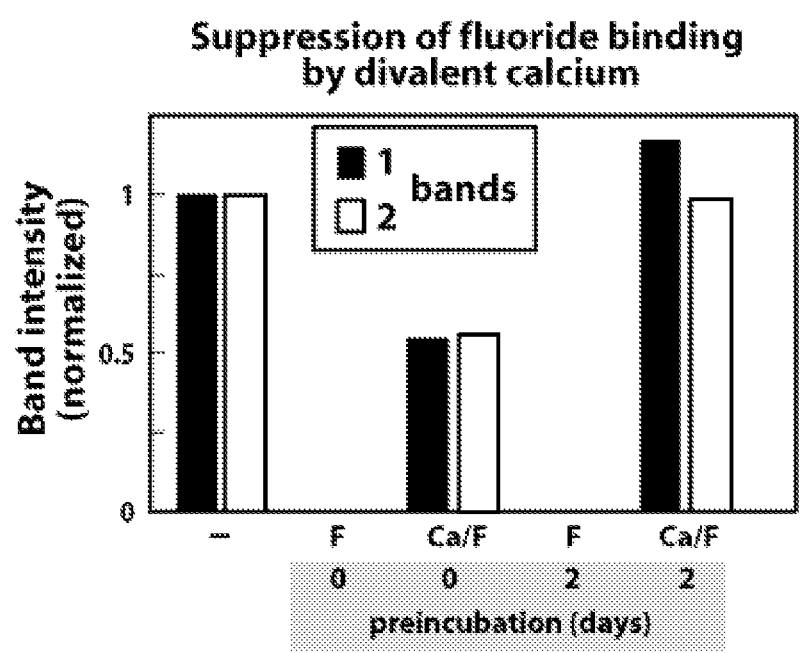
FIG. 7 is a bar graph of band intensity (normalized) versus preincubation (days). Fluoride in the presence or absence of divalent calcium ions. Plot of the band intensities for regions 1 and 2 denoted in A. Intensities in the (−) and (F) lanes were normalized to 1 and 0, respectively.

To add further support for fluoride as the ligand, the fact that divalent calcium ions form a strong complex with this anion were exploited (J. T. Dobbins, H. A. Ljung, J. Chem. Ed. 12, 586 (1935)). Addition of Ca$^{2+}$ in excess over fluoride at the start of an in-line probing assay diminishes RNA structural modulation, while a two-day preincubation of the ion mixture results in the complete loss of modulation (FIG. 7). This delay in Ca$^{2+}$-mediated inhibition of fluoride-dependent structure modulation is consistent with the slow rate of complex formation between calcium and fluoride ions (F. F. Feagin, et al, Calc. Tiss. Res. 10, 113 (1972)).

ii. Selective Recognition of Fluoride by Natural RNA Aptamers.

In addition to the surprising observation that an aptamer made of RNA (a polyanion) can bind a single fluoride anion, there are several other aspects of this finding that merited further investigation. For example, cells have high levels of chloride ions as well as numerous small negatively-charged metabolites, and the failure to exclude these from triggering fluoride riboswitches would disrupt normal genetic regulation. Most importantly, the fluoride binding observed could be spurious, and therefore may not be reflective of the true function of this riboswitch class. Given these concerns, a series of additional biochemical assays were conducted to assess whether fluoride binding is both selective and biologically relevant.

Selective fluoride binding was established by testing other halogen anions (chloride, bromide and iodide) as well as various other inorganic and organic anions (Tables 1 and 2) via in-line probing. Strikingly, the 78 Psy RNA rejects these other anions even at extremely high concentrations. For example, the 78 Psy aptamer structure remains unchanged even when exposed to chloride ion concentrations as high as 2.5 M, indicating that the aptamer binds fluoride at least 40,000 fold more tightly. Similarly, hydroxide ions do not trigger RNA conformational changes up to a pH of 9.7 (50 μM), at which point the RNA secondary structure becomes denatured. It was also determined that the biologically relevant gases carbon monoxide and nitric oxide are rejected by the RNA, despite their small sizes and electronic character. This remarkable selectivity is consistent with a biological role for the RNA as a fluoride sensor.

Tables 1 and 2: Compounds tested for binding by fluoride aptamers

TABLE 1

| Halides | Small anions | | Gases |
|---|---|---|---|
| $F^-$ | $*OH^-$ | $*HCOO^-$ | $*CO$ |
| $*Cl^-$ | $SH^-$ | $HCO_3^-$ | $*NO$ |
| $Br^-$ | $CN^-$ | $SO_4^{2-}$ | |
| $I^-$ | $SCN^-$ | $*H_2PO_4^-$ | |
| | $NO_3^-$ | $HAsO_4^{2-}$ | |
| | $NO_2^-$ | | |

*All ligands tested at 10 mM except these six: $Cl^-$, up to 2.5M; $OH^-$, up to 100 μM (pH 10); $HCOO^-$, NO and $H_2PO_4^-$, 1 mM; CO, ~0.9 mM.

TABLE 2

| Other Compounds | |
|---|---|
| pApA | nicotinic acid |
| pGpA | niacinamide |
| pAp | methylthioadenosine |
| c-di-GMP | cystathionine |
| c-di-AMP | methionine |
| GTP | histidine |
| TPP | spermidine |
| SAM | 3-phosphoglycerate |
| SAH | methylglyoxal |
| 5'-deoxyadenosine | carbamoyl phosphate |
| *2,8-dihydroxyadenine | ribose-5'-phosphate |
| **8-hydroxyguanine | glucose-6-phosphate |
| **8-hydroxyguanosine | fructose-6-phosphate |
| **8-hydroxydeoxyguanosine | fructose-1,6-biphosphate |
| ***formaldehyde | phosphoribosyl pyrophosphate |
| ****trifluoroacetic acid | phosphoenolpyruvate |
| pyridoxamine | FAD |
| pyridoxic acid | |
| pyridoxal phosphate | |

All ligands tested at 1 mM except the following:
*50 μM;
**100 μM;
***10 mM;
****1.3 mM.

Numerous previous studies of riboswitch aptamers have proven that the distinct evolutionarily conserved structures and sequences are essential for forming ligand-binding pockets (R. K. Montange, R. T. Batey, *Annu. Rev. Biophys.* 37, 117 (2008); A. Serganov, *Curr. Opin. Struct. Biol.* 19, 251 (2009); J. Zhang, et al., *Biochemistry* 49, 9123 (2010)). Therefore, it was reasoned that any mutations to the fluoride aptamer that disrupt conserved structures or that alter any of its strictly-conserved nucleotides should perturb anion binding if fluoride indeed is the natural ligand. Alternatively, if the aptamer has an as yet undiscovered natural ligand and only fortuitously binds fluoride, then some mutations that preclude binding of the natural ligand would still permit complex formation with fluoride.

Figure 8:
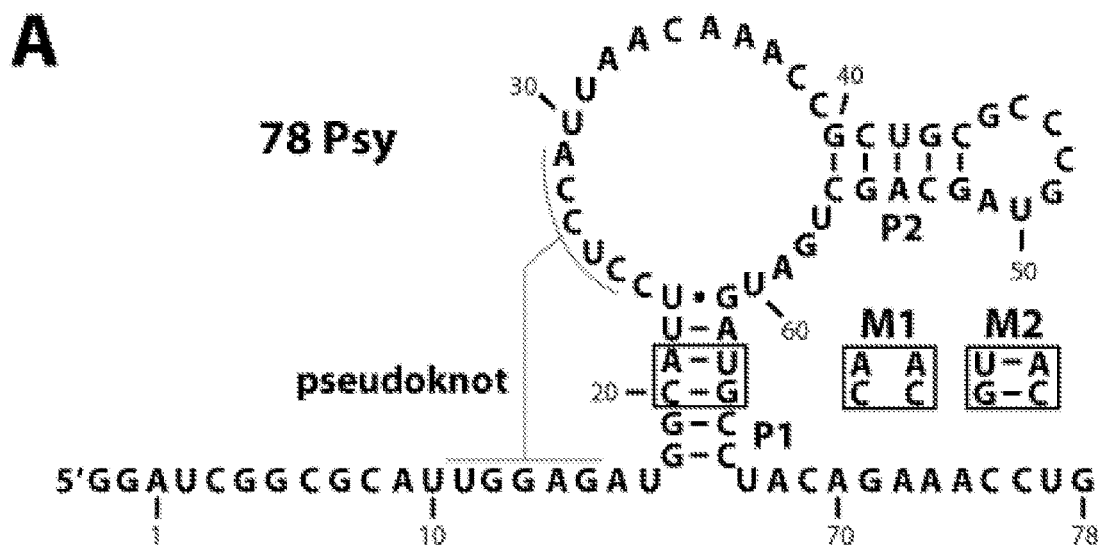
FIG. 8 shows the sequence and secondary structure of the 78 Psy RNA construct (SEQ ID NO:352) and mutations used to evaluate the importance of P1.
Figure 9:
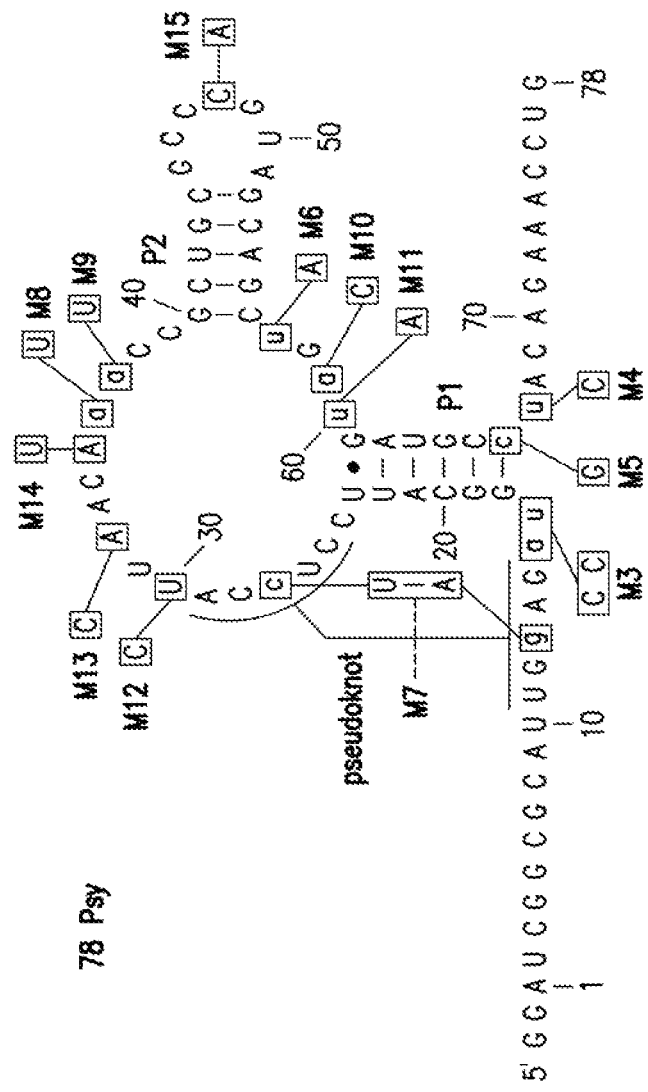
FIG. 9 shows the sequence (SEQ ID NO:352) and secondary structure of the 78 Psy RNA construct and various mutations used to evaluate the importance of certain nucleotides. Eleven of the most conserved nucleotides are written in lowercase letters, while other nucleotides are in Capital letters.

All mutations that alter the strictly-conserved sequence or secondary structure of the aptamer likewise adversely affect fluoride binding. For example, mutations that disrupt the P1 stem (FIG. 8) cause complete loss of fluoride binding, while compensatory mutations that alter the wild-type (WT) sequence but that restore base pairing also restore binding. Moreover, any mutation to one of the 11 most highly conserved nucleotides (FIG. 9) diminishes or eliminates fluoride binding, whereas mutations at non-conserved positions have no effect. Again, these findings indicate that fluoride is not a ligand mimic, but rather is the biologically-relevant ligand for crcB motif RNAs.

iii. Gene Control by Fluoride-Responsive Riboswitches.

Figure 10:
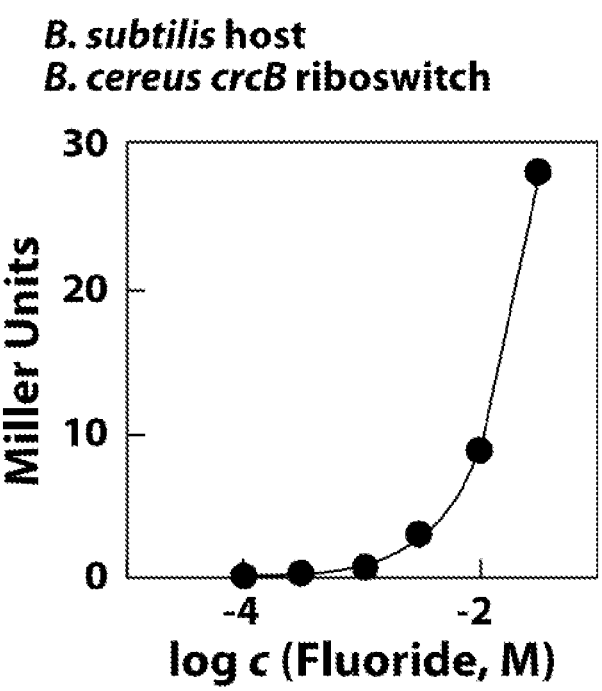
FIG. 10 is a line graph of Miller Units versus log c (Fluoride, M). Fluoride-induced reporter gene activity controlled by the riboswitch associated with *B. cereus* crcB. Plot of the β-galactosidase reporter activity versus fluoride concentration in liquid medium supporting growth of transformed *B. subtilis* cells as quantified using Miller assays.

Additional support for the biological relevance of fluoride binding by RNA was sought by using riboswitch-reporter fusion constructs. Specifically, a representative crcB motif RNA from the *B. cereus* crcB gene was joined (transcriptional fusion) to a lacZ reporter gene and the construct was integrated into the chromosome of *Bacillus subtilis*. β-galactosidase reporter activity was not detected in the absence of added fluoride, whereas increasing amounts of the anion induced high levels of expression as revealed by blue color in culture media supplemented with X-gal, and as revealed by Miller assays using ONPG (FIG. 10).

Figure 2A:
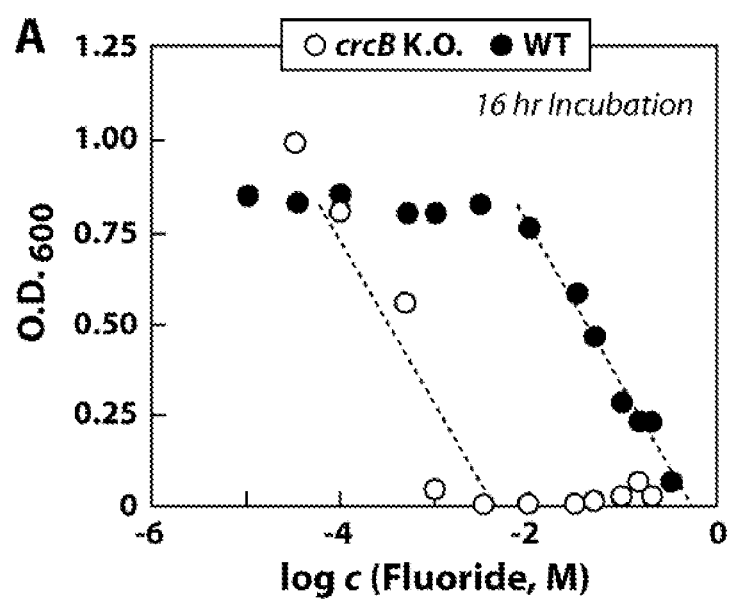
FIGS. 2A and 2B are line graphs showing O.D.$_{600}$ and Miller Units, respectively, versus Log c (Fluoride, M). (A) Comparison of growth curves for WT versus ΔcrcB strains of *E. coli* when grown in varying concentrations of fluoride. Dashed lines estimating fluoride-dependent growth inhibition are depicted as identical. (B) Riboswitch reporter fusion constructs reveal fluoride-dependent gene control. Plot of the β-galactosidase reporter activity versus fluoride concentration in liquid media supporting growth of transformed *E. coli* cells as quantified using Miller assays. WT and crcB KO *E. coli* cells grown in media supplemented with 50 mM NaCl (no added fluoride) yielded 0.3 and 15.5 Miller units, respectively.
Figure 2B:
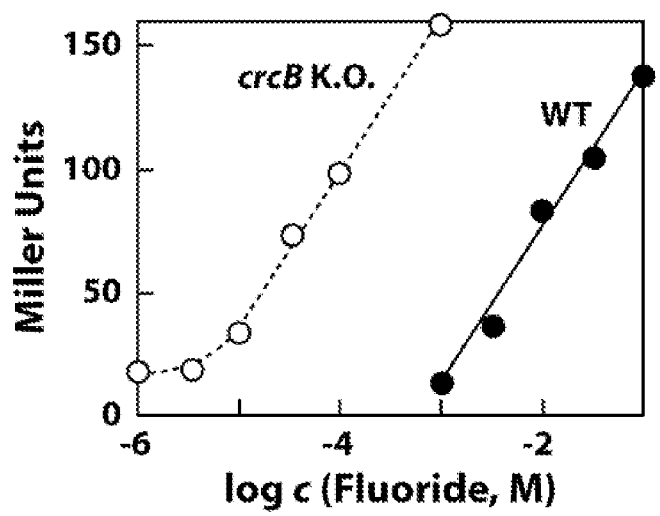
Figure 11A:
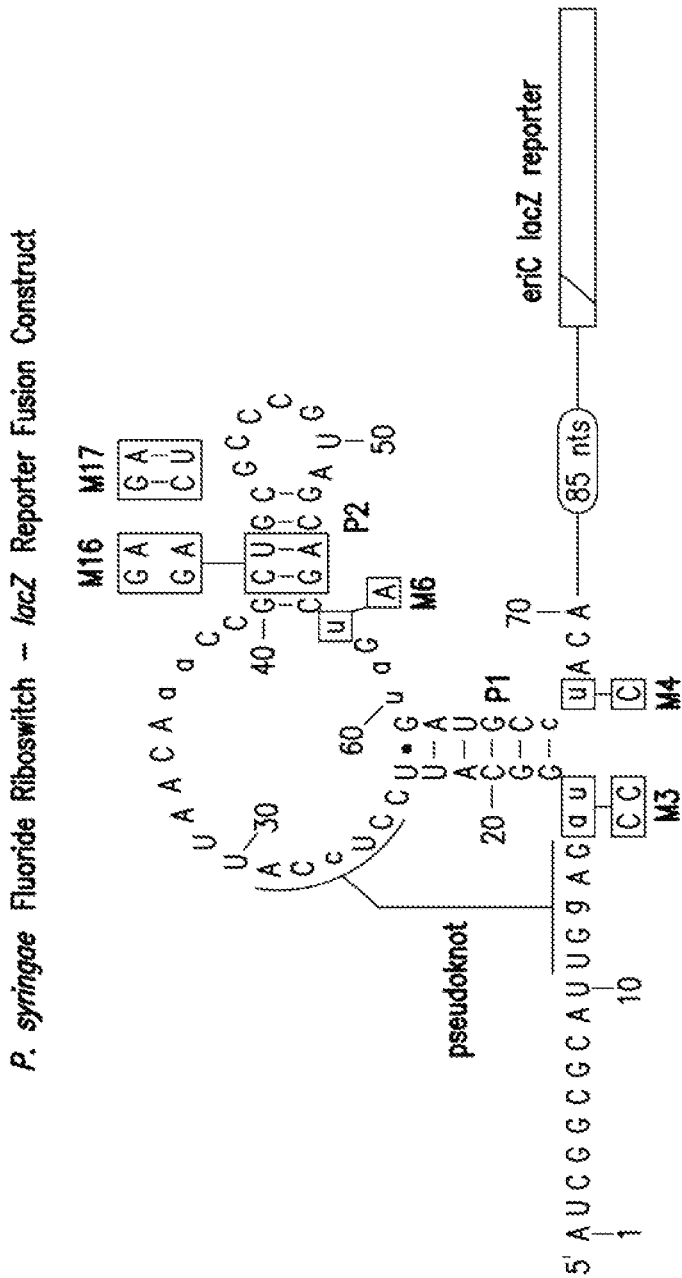
FIGS. 11A and 11B are an assessment of gene control by WT and mutated variants of a *Pseudomonas syringae* fluoride-responsive riboswitch in *E coli* cells. (A) Sequence (SEQ ID NO:353) and secondary structure of the wild-type fluoride riboswitch aptamer from the eriC gene of *P. syringae* and various mutants fused to the β-galactosidase reporter gene (lacZ). Eleven of the most conserved nucleotides are in lowercase letters. Diagonal line reflects the fusion of the first eight codons of eriC to the ninth codon of the lacZ gene. (B) Plot of the level of β-galactosidase activity in cells containing the reporter constructs depicted in the presence of 40 mM fluoride. The Miller unit values determine for all six constructs in the presence of chloride were approximately zero.
Figure 11B:
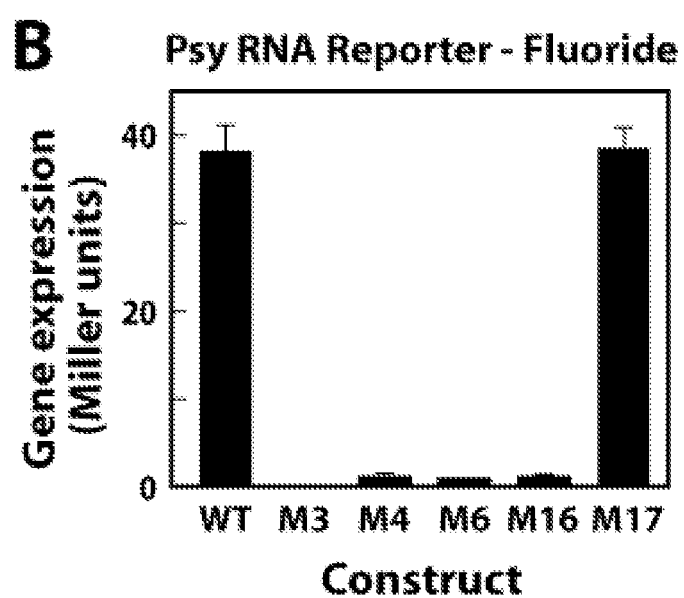

Similarly, a representative crcB motif RNA from the *P. syringae* eriC gene was joined (translational fusion) to lacZ, and the plasmid-based construct was transformed into an *Escherichia coli* strain with its natural lacZ gene disabled. Again, reporter gene expression was not detected for cells grown on solid medium in the absence of added fluoride, whereas β-galactosidase expression was readily apparent in cells grown on medium supplemented with 50 mM fluoride. In addition, Miller assays conducted with ONPG reveal increasing levels of β-galactosidase expression with increasing amounts of fluoride added to liquid medium (FIG. 2B). A series of variant reporter constructs with mutations that alter highly-conserved aptamer nucleotides or that disrupt P3 stem formation fail to be activated by fluoride, whereas an altered P3 sequence that retains base pairing exhibits fluoride induction at a level equivalent to WT (FIG. 11). These in vivo results parallel the fluoride-binding activity of mutants when tested in vitro as described above. In total, the findings confirm that fluoride triggers gene expression via distantly related riboswitch representatives from both Gram-positive and Gram-negative bacteria.

iv. Evidence that CrcB Proteins are Fluoride Transporters.

If some genes associated with fluoride riboswitches code for proteins that reduce the cellular concentration of fluoride, the genetic knockout (KO) strains lacking these genes should become more sensitive to this anion. Similarly, these KO strains should exhibit robust riboswitch-mediated reporter expression at lower concentrations of fluoride in the medium compared to WT due to increased cellular retention of fluoride. The crcB genes, which are the most common genes associated with fluoride riboswitches, can code for fluoride transporters. CrcB proteins are predicted to function in cell membranes (M. Rapp, et al., *Nat. Struct. Mol. Biol.* 13, 112 (2006)) and belong to a superfamily that is comprised predominantly of transporters (R. D. Finn, et al., *Nucleic Acids Res.* 38, D211 (2010)), which is consistent with the discoveries disclosed herein.

Although *E. coli* lacks a representative of the new-found fluoride riboswitch class, this bacterial species does code for a CrcB protein. Therefore, WT and crcB KO strains of *E. coli* are ideal for assessing cellular fluoride levels and its effects on cell growth by exploiting the same riboswitch-reporter fusion construct used in this bacterium as described above. It was determined that the crcB KO strain fails to grow in the presence of 50 mM fluoride, whereas WT cells exhibit robust growth. While both WT and KO cells grow on medium supplemented with only 0.2 mM fluoride, the KO cells exhibit higher reporter gene activity.

Intriguingly, KO cells exhibit a detectable level of reporter expression even when the medium is not supplemented with fluoride. This observation could be due to the presence of low micromolar amounts of fluoride contaminating the reagents used to make the media. In liquid medium, the WT strain requires approximately two orders of magnitude higher fluoride concentration to trigger reporter gene expression compared to the KO strain (FIG. 2). These results indicate that crcB, the gene most commonly associated with fluoride riboswitches, codes for a protein that reduces the concentration of fluoride in cells, thus avoiding the build-up of this toxic anion.

v. Bacterial Growth Inhibition by Fluoride Correlates with Riboswitch Regulation.

Figures 3A, 3B:
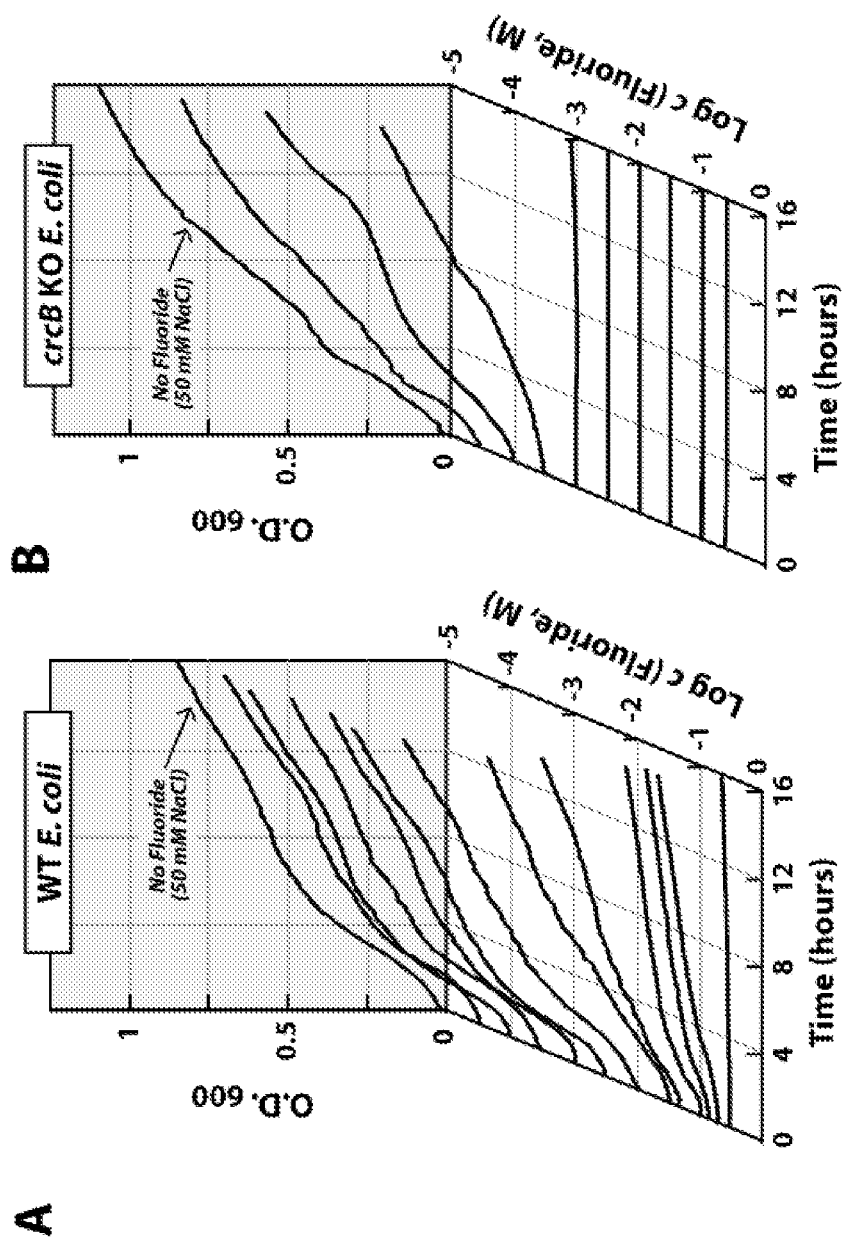
FIGS. 3A, 3B, 3C and 3D are line graphs showing fluoride toxicity evaluated by bacterial growth curves. (A) Liquid cultures supplemented with specific amounts of sodium fluoride were inoculated with identical amounts of WT *E. coli* cells and the optical density (O.D.) at 600 nm was periodically recorded over a 16 hr period. (B) Growth curve plots for the crcB KO strain of *E. coli* were conducted using conditions identical to those for WT. (C) Comparison of O.D.$_{600}$ for WT and crcB KO *E. coli* cells after 16 hr incubation. (D) Comparison of O.D.$_{600}$ for WT and crcB KO *E. coli* cells after 5 hr incubation in media at pH 7.5 or 5.5.

To assess whether there is a correlation between cell growth and reporter gene activity as fluoride concentrations are increased, a series of growth curves was recorded for WT and KO cells at various fluoride concentrations in liquid media. For WT $E.$ $coli$ cells, growth becomes noticeably reduced at 30 mM NaF, and a minimum inhibitory concentration (MIC) is apparent at ~200 mM (FIG. 3A). In stark contrast, the growth of the $E.$ $coli$ strain carrying the crcB gene KO is inhibited by micromolar amounts of fluoride, and exhibits an MIC of slightly higher than 1 mM (FIG. 3B). Several other housekeeping gene KO strains ($\Delta$clcA, $\Delta$clcB, $\Delta$pgi, $\Delta$pgm, $\Delta$ppx, $\Delta$ppk) do not cause sensitivity to fluoride. These observations indicate that deletion of the CrcB protein does not cause general distress and indirect sensitivity to toxic agents, but rather has a direct role in alleviating fluoride toxicity.

Figures 3C, 3D:
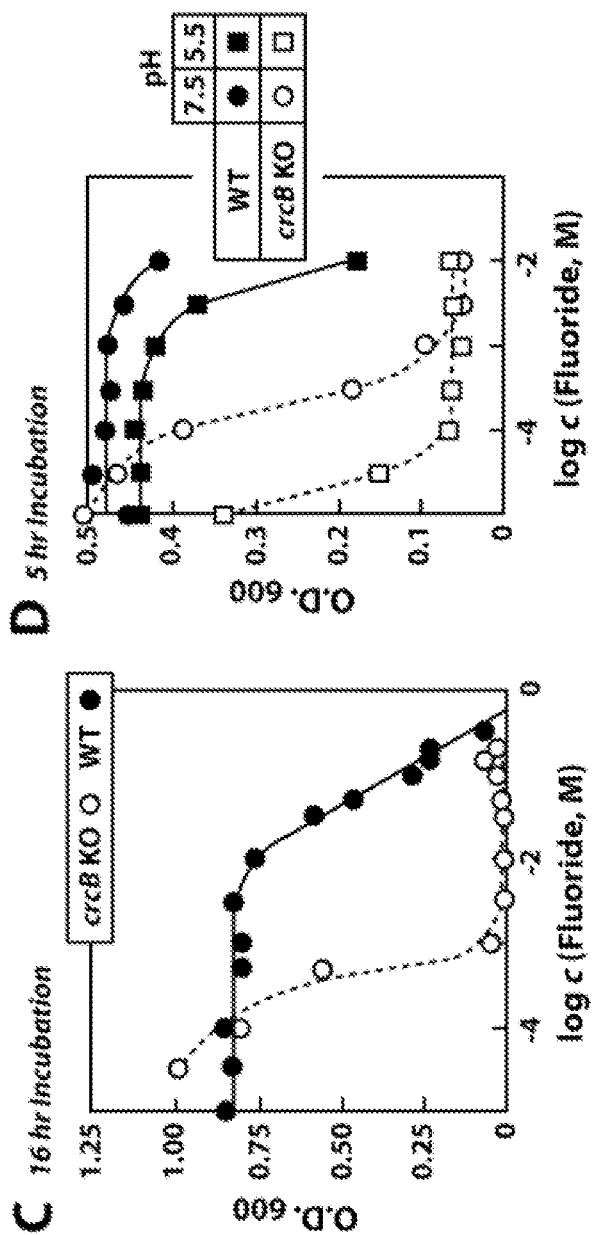

A comparison of the growth curves (FIG. 3) with the reporter gene expression driven by fluoride riboswitches (FIG. 2) indicates that reporter expression increases in proportion to the amount of fluoride in the culture media until the anion concentration becomes toxic to cells. Importantly, both growth inhibition (FIG. 3B) and reporter gene expression (FIG. 2) phenotypes are similarly shifted to lower fluoride concentrations in crcB KO cells. This finding indicates that CrcB proteins function as fluoride efflux transporters.

vi. Evidence that EriC Proteins, Like CrcB Proteins, are Fluoride transporters.

There are numerous other genes associated with fluoride riboswitches whose functions are expected to mitigate fluoride toxicity in bacteria and archaea (FIG. 4A; FIG. 12). It is intriguing to note that several gene classes observed to associate with fluoride riboswitches encode proteins such as enolases (J. Qin, et al. $Biochemistry$ 45, 793 (2006)), hydrogenases (W. G. Crewther, $Aust.$ $J.$ $Biol.$ $Sci.$ 6, 205 (1953)), and polyphosphatases (V. R. Samygina, et al., $J.$ $Mol.$ $Biol.$ 366, 1305 (2006)) that have previously been shown to be strongly inhibited by fluoride. It is likely that many cells use fluoride riboswitches to increase production of these enzymes to lessen the toxic effects of this anion.

Another gene commonly associated with fluoride riboswitches is eriC. This is a widespread gene family coding for ClC-type ion transporter proteins (Matulef, M. Maduke, $Mol.$ $Membr.$ $Biol.$ 24, 342 (2007)), wherein some representatives from bacteria and humans have well proven specificity for chloride (Dutzler, et al., $Nature$ 415, 287 (2002)) and serve as active transporters for this anion (Accardi and Miller, $Nature$ 427, 803 (2004)). Certain EriC variants whose expression is controlled by fluoride riboswitches (called $EriC^F$ herein) can eject fluoride from cells, thereby preventing toxicity.

There is a nearly exclusive association of fluoride riboswitches with a distinct subgroup of highly related eriC variants. Many homologs of experimentally validated chloride-specific EriC proteins from bacteria to humans carry highly conserved amino acids that form the selectivity filter of the anion channel (Table 4). However, $EriC^F$ homologs commonly associated with fluoride riboswitches carry a distinct set of amino acids in their channels. This finding strongly indicates that the $EriC^F$ protein subgroup members are transporters for fluoride anions rather than for chloride.

Figure 5:
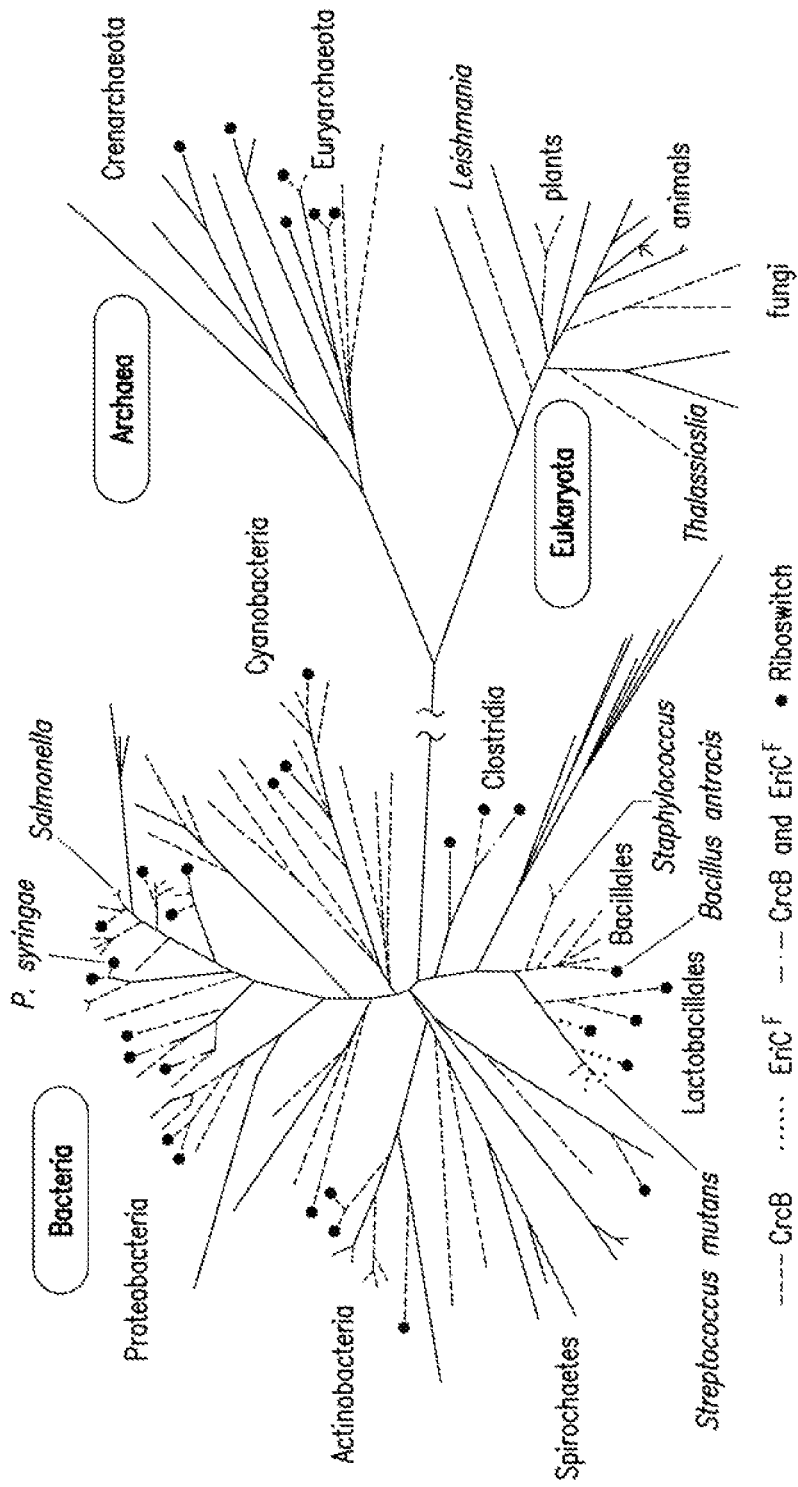
FIG. 5 shows the distribution of fluoride riboswitches and fluoride transporters among organisms from the three domains of life. Selected taxa are depicted based on a previous tree of life (F. D. Ciccarelli, et al. *Science* 311, 1283 (2006)).

The biological function of an $EriC^F$ variant was assessed by expressing a representative from $P.$ $syringae$ in the $E.$ $coli$ strain lacking the CrcB protein. Consistent with fluoride transporter activity, the $P.$ $syringae$ $eriC^F$ gene rescues growth of the $E.$ $coli$ crcB KO strain to yield cells that again can withstand high fluoride concentrations in both liquid and solid media (FIG. 4B). The functional equivalency of $EriC^F$ and CrcB proteins is likewise indicated by their distributions amongst bacterial species (FIG. 5). The genes for these fluoride transporters are rarely observed in the same species under the control of fluoride riboswitches, indicating their biochemical roles are not synergistic in alleviating fluoride toxicity, but rather their roles are likely to be identical. These findings provide the first indications that many species can employ specific protein transporters to remove cytoplasmic fluoride, thereby evading its toxic effects.

vii. Plant and Fungal Species Carry Fluoride Transporters.

In contrast to the narrow phylogenetic distribution of fluoride-riboswitch-associated $eriC^F$ genes, crcB genes associated with fluoride riboswitches are distributed broadly among bacteria and archaea (FIG. 5). Furthermore, riboswitches are associated with the genes for CrcB proteins that vary greatly in amino acid sequence, indicating that all CrcB proteins have the same function even if they lack an association with a riboswitch. If true, then the presence of a crcB gene in an organism's genome can be used as an indicator that a species at least occasionally experiences fluoride toxicity.

Given the wide distribution of crcB genes in organisms from all three domains of life (FIG. 5), a surprisingly large number of organisms likely contend with fluoride toxicity. These organisms can gain a selective advantage by sensing fluoride or its associated stresses, and then by expressing toxicity mitigation proteins. Particularly noteworthy is the observation that protozoan and diatom species, as well as many fungal and plant species, carry a crcB gene. This indicates that some eukaryotic cells also take action to cope with the toxic effects of fluoride. Curiously, other eukaryotic lineages do not appear to carry CrcB or $EriC^F$ homologs. It is not clear if these eukaryotes, including humans, are only rarely exposed to high fluoride levels, if they have become less sensitive to this anion, or if they have unrecognized fluoride sensory and toxicity response systems awaiting discovery.

viii. Use the Riboswitch-Reporter Fusion System in a HTP Screen to Identify Compounds that Increase Fluoride Concentrations in Bacteria.

To date, no compounds are known that selectively augment the antimicrobial effects of fluoride. Likewise, there are no chemical tools that can be used to probe the functions of proteins that many bacterial, archaeal and fungal cells use to resist the toxic effects of fluoride. HTP screening can be used for the rapid identification of compounds that target bacterial fluoride toxicity mitigation systems. Since *Streptococcus mutans* (a cause of dental caries) has two related eriC$^F$ genes, targeting this fluoride transporter class is of particular interest.

Figures 14A, 14B:
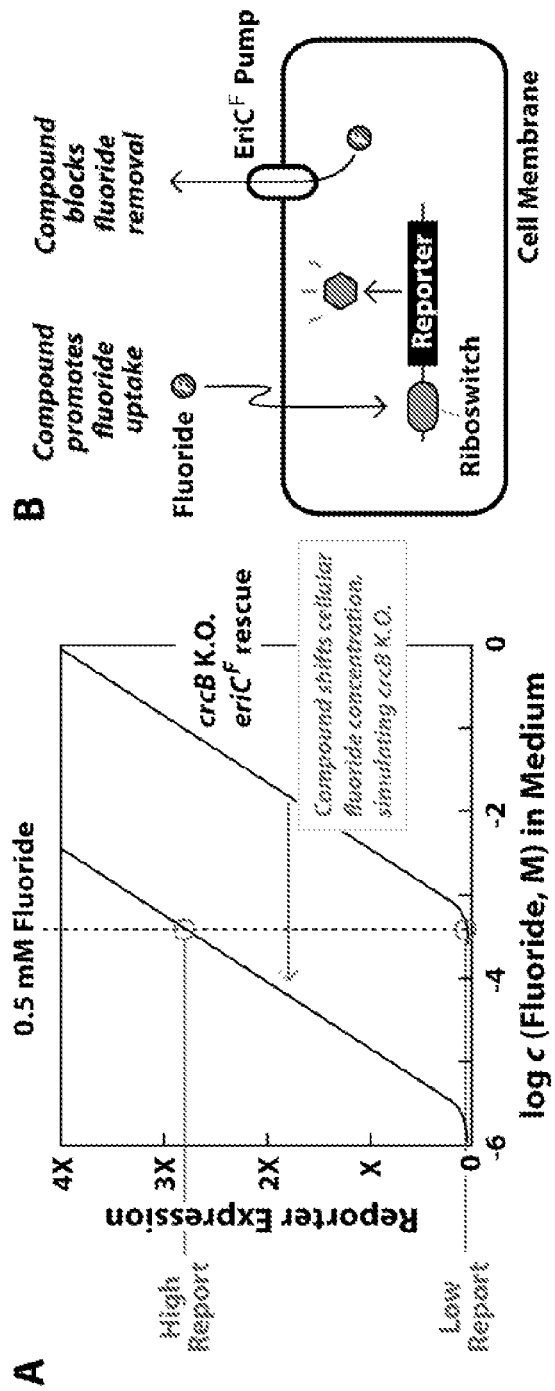
FIGS. 14A, 14B, 14C, and 14D show a HTP screen strategy and activity of hit compounds. (A) Reporter gene expression characteristics in crcB K.O. cells rescued with eriC$^F$ (right curve) versus cells with the same genetics under the influence of a compound that increases internal fluoride concentrations (e.g. fluoride transporter inhibition (EriC protein inhibition)). At 0.5 mM fluoride in the culture medium, wells containing active compounds will yield reporter gene expression. (B) Two general mechanisms of action (shaded boxes) for compounds that increase fluoride ion concentration in cells. (C) Examples of hit compounds identified by HTP screening. (D) Reporter activity of three hit compounds examine in *E. coli* grown at 30 mM fluoride. Reporter expression values (Fluorescence Units×10$^8$) were corrected for the value in the absence of hit compound. Lower values at high compound concentrations also correspond to lower cell growth, possibly due to the toxic effects of increased fluoride concentrations in cells.
Figures 14C, 14D:
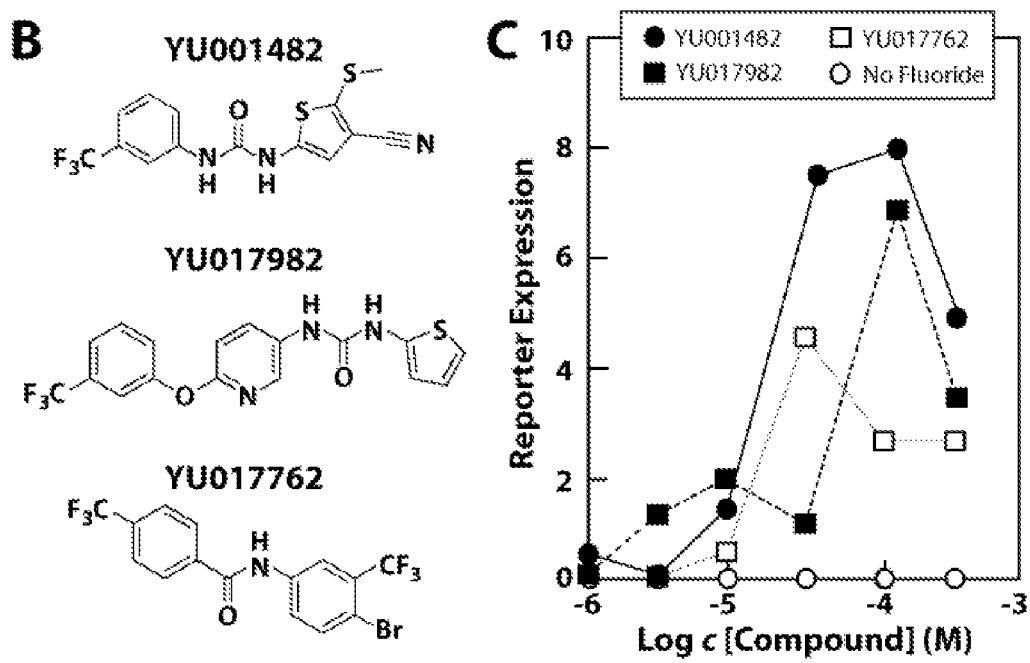

An in vivo fluoride concentration sensor system based on the fluoride riboswitch from *B. cereus* (a close relative of *Bacillus anthracis*) has been established. The riboswitch from the crcB gene was fused to a β-galactosidase reporter gene to create a riboswitch-reporter construct that increases reporter enzyme activity with increasing cellular concentration of fluoride. This construct was transfected into *E. coli* cells and used to conduct an initial HTP screen that yielded dozens of hits. The riboswitch-reporter fusion constructs in hand can be coupled to expression of an eriC$^F$ rescue gene to implement an HTP screen (FIG. 14). Each hit is expected to trigger expression by increasing the concentration of fluoride in cells, either by enhancing uptake or by reducing transporter-mediated removal (FIG. 14A). Examples of hits (FIG. 14C) and their effects on reporter gene expression (FIG. 14D) indicate that a diversity of chemical structures indeed can trigger expression driven by a fluoride riboswitch.

Constructs with improved characteristics (e.g., GFP reporter) will allow even greater efficiency to facilitate screening with much larger chemical libraries. Compounds that block EriC$^F$ should mimic the phenotype of a crcB K.O. strain, which yields maximal reporter gene signal at 1 mM fluoride in the growth medium (FIG. 2B), at which point the cells begin to experience growth inhibition (FIG. 2A). In contrast, eriC$^F$-rescued cells show almost no growth inhibition 1 mM fluoride, and require ~10 mM fluoride concentration in the culture medium to cause growth inhibition and reporter expression.

Thus, a chemical-induced knock-out of EriC$^F$ function (e.g. a transporter-blocking compound) in rescued *E. coli* cells will induce a maximal signal for HTP screening applications (FIG. 14A). Other mechanisms that bias the internal concentration of fluoride to higher levels are also possible (FIG. 14B). Enhancing fluoride uptake could be achieved by permeablizing cell membranes or by forming membrane-permissive complexes with fluoride. Alternatively, compounds could prevent expression of the eriC$^F$ gene or blocking proper localization of the EriC$^F$ protein.

ix. Mechanisms of Action for Specific Fluoride Agonist Compounds.

The discovery of a riboswitch class and its associated genes, the creation of in vivo reporters of fluoride concentrations, and the proposed isolation of compounds that modulate fluoride concentrations in cells, provides some of the advances necessary to fully understand how bacteria and other organisms cope when exposed to toxic levels of this anion. As noted above (FIG. 14B), there are several possible proteins or systems that help maintain low fluoride concentrations in cells. A successful screen should produce multiple different compound classes that target these various processes.

The precise proteins or other biological targets that are affected by hit compounds can be revealed by HTP screening. This can be achieved by using both biochemical and genetic approaches employed in the current studies, or developed for use in this study. Establishing compound targets can reveal mechanisms and provide validated targets for future antibacterial drug development.

Assignment of functional classes can be made by comparing the effects of each hit on the *E. coli* crcB K.O. and eriC$^F$ rescue cells used for the original screen versus the crcB K.O. strain to assess whether the in vivo effects of fluoride are additive. Assignment of compounds as fluoride-retention enhancers versus fluoride-uptake enhancers can be achieved by exploiting the riboswitch-reporter fusion construct and two *E. coli* genetic variants. For example, compounds that block Eric$^F$ transporter action should not cause any increased fluoride toxicity or increase reporter gene expression in the WT or crcB K.O. strains.

In contrast, compounds that enhance gene expression effects and toxic effects of a given fluoride concentration in culture regardless of the genetic background are expected to promote fluoride uptake. Compounds that enhance fluoride uptake are less likely than transporter inhibitors to experience a limit to their efficacy. Transporter inhibitors should reach saturation and block all available transporters, thus reaching a maximum efficacy that should perfectly correspond to that observed for the crcB K.O. Alternatively, if a compound progressively enhances the effects of fluoride that surpasses the level of the genetic K.O., then the compound is expected to promote fluoride uptake. Compounds that exhibit distinct characteristics (e.g. saturation without correlation to genetic K.O. maxima) may belong to other mechanistic classes.

x. Mechanistic Class: Transporter Blockers

A fluoride riboswitch fused to a beta-galactosidase reporter gene is present in *E. coli* cells and cells are exposed to concentrations of sodium fluoride and imipramine (x-axis) as noted. The structure of imipramine is shown below.

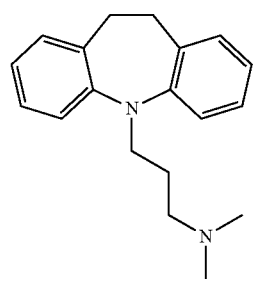 [SMILES: CN(C)CCCN1c2ccccc2CCc2ccccc21]

Figure 15:
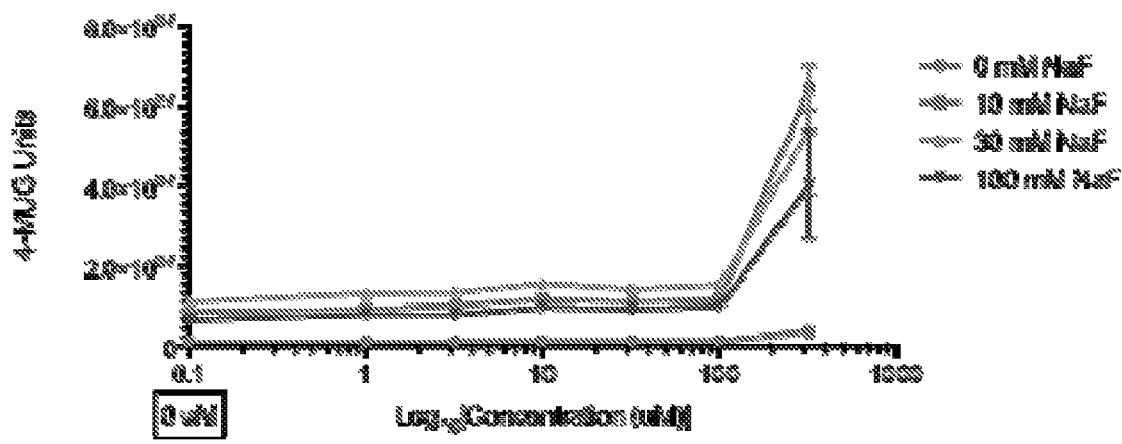
FIG. 15 is a line graph showing 4-MUG Units versus Log$_{10}$[Concentration (μM)] in 30 mM, 10 mM, 100 mM, and 0 mM NaF in order from top to bottom at the 10 uM concentration.

At 330 μM imipramine, cells exhibit increased expression of the reporter gene as detected by fluorescence using the enzyme substrate 4-MUG (FIG. 15). This level of reporter gene expression with imipramine is substantially reduced when the same riboswitch-reporter fusion construct is used in *E. coli* cells lacking the gene to express the fluoride transporter protein CrcB. These results indicate that imipramine (a previously known transporter inhibitor) blocks this fluoride transporter.

4. Discussion.

A widespread riboswitch class that selectively senses fluoride and controls genes to overcome the toxic effects of elevated fluoride concentrations has been discovered. It has been known for almost a century that bacterial growth is inhibited by high fluoride concentrations (R. J. Lesher, et al., *Antimicrob. Agents Chemother.* 12, 339 (1977); M. Maltz, et al., *J. Dent. Res.* 61, 786 (1982); R. E. Marquis, et al., *FEMS Microbiol. Rev.* 26, 493 (2003); G. Bibby, M. Van Kesteren, *J. Dent. Res.* 19, 391 (1940) and citations therein). The finding resolves a longstanding mystery regarding why some species carry sensor and mitigation systems for other toxic metals such as arsenic, cadmium, lead, and silver, whereas an analogous fluoride-specific system had been notably absent (S. Silver, *Gene* 179, 9 (1996)).

Several known riboswitch classes exploit negative charges on metabolites as part of the molecular recognition contacts with their ligands (N. Sudarsan, et al., *Science* 321, 411 (2008); E. R. Lee, et al., *Science* 329, 845 (2010); W. C. Winkler, et al., *Nature* 428, 281 (2004); W. C. Winkler, et al., *Nature* 419, 952 (2002); W. C. Winkler, et al., *Proc. Natl. Acad. Sci. USA* 99, 15908 (2002)). However, the fluoride aptamers described in this study respond to a negative point charge, and the polyanionic character of RNA alone should make it a far-inferior medium compared to protein polymers for forming an anion binding pocket. Regardless, the data unambiguously supports the conclusion that a highly conserved and widespread RNA motif selectively binds fluoride.

Fluoride ions do have unique properties compared to other anions, and one or more of these features must be exploited by crcB motif RNAs to selectively respond to fluoride and reject other closely related anions. RNAs are known to form pockets that directly bind chloride ions (P. Auffinger, et al., *Structure* 12, 379 (2004)), and therefore it seems conceivable that RNA could form a fluoride-specific pocket without the use of a cofactor. Selectivity could be based on the ionic radius of fluoride (0.133 nm), which is smaller than that of chloride (0.181 nm) or any other negatively-charged inorganic or organic chemical species. However, the most likely RNA exploits one or more $Mg^{2+}$ ions to form selective bridging contacts between the anion and functional groups within the aptamer.

In this study the roles of CrcB and $EriC^F$ in fluoride toxicity mitigation were assessed. The data indicate that evolution may have given rise to at least two distinct types of fluoride ion transporters, wherein one type ($EriC^F$) appears to have been co-opted from a preexisting and widespread class of chloride transporters. Importantly, the association of fluoride riboswitch representatives with numerous other types of genes provides many other opportunities to establish the roles of proteins that might be important for fluoride toxicity mitigation.

Further analysis of proteins associated with fluoride riboswitches also may help establish how some eukaryotes that lack both CrcB and $EriC^F$ contend with high fluoride levels. For example, in humans and other mammals, high intravenous fluoride levels cause heart arrhythmia and death due to a sharp increase in $K^+$ concentrations in the blood (hyperkalemia) (M. E. McIvor, C. C. Cummings, *Toxicol. Lett.* 38, 169 (1987); M. E. McIvor, et al., *Ann. Emerg. Med.* 16, 777 (1987)). It is interesting to note that two gene classes commonly associated with fluoride riboswitches in bacteria are related to $K^+$ transport, hinting that transport of this cation can be involved in mechanisms by which some cells overcome fluoride toxicity.

Some organisms that carry crcB or $eriC^F$ genes lack predicted fluoride riboswitches. For example, *E. coli* lacks a recognizable fluoride riboswitch representative, but its crcB gene was shown in this study to confer two orders of magnitude increased fluoride tolerance. Of particular interest is *Streptococcus mutans*, a prominent cause of dental caries (H. Koo, *Adv. Dent. Res.* 20, 17 (2008)). All *Streptococcus* species with sequenced genomes lack representatives of the fluoride riboswitch class, but nevertheless they carry either crcB or $eriC^F$ genes within similar arrangements of flanking genes. This genetic arrangement again indicates that the two gene products have similar functions, which the findings predict are to overcome otherwise toxic levels of fluoride. It is likely that organisms such as *E. coli* and *S. mutans* possess an alternate mechanism for fluoride sensing and gene regulation that remains to be elucidated.

In rare instances, organisms that carry more than two fluoride riboswitches have been found, indicating that some species can have special adaptations to overcome extreme fluoride concentrations. Particularly noteworthy is the bacterium *Methylobacterium extorquens* DM4, which encodes at least 10 fluoride riboswitches in its genome. This species is known for its ability to consume halogenated hydrocarbons as a food source (Gälli and Leisinger, *Conserv. Recy.* 8, 91 (1985)). The organism has been shown to survive on dichloromethane, and the pertinent halogenase enzyme also can catalyze the degradation of dibromomethane (Vuilleumier et al., *Biochem. Biophys. Res. Commun.* 238, 452 (1997)). Given the proven substrate range of this halogenase in vitro, this organism can degrade fluorinated hydrocarbons, which might require that it carry robust fluoride sensor and toxicity mitigation response systems for rapid growth on fluorinated food sources.

One of the main sources of human exposure to high fluoride concentrations is from consumer products such as fluoridated toothpaste. Currently, consumer brand toothpastes typically contain sodium fluoride in an amount equivalent to approximately 50 mM (or 0.05 moles per liter of paste), which is well within the range of fluoride ion concentrations that hinder bacterial growth. Furthermore, major prescription brands of toothpaste contain five-fold higher concentrations of fluoride (~250 mM), which is above the *E. coli* MIC for this anion (FIG. 3A). The findings are consistent with the prior hypothesis (Marquis, *Can. J. Microbiol.* 41, 955 (1995); Levine, *Br. Dent. J.* 140, 9 (1976); Koo, *Adv. Dent. Res.* 20, 17 (2008); Hamilton, *J. Dent. Res.* 69, 660 (1990); Van Loveren, *Caries Res.* 35, 65 (2001)) that part of the anti-caries activity of some toothpastes may be due to the antibacterial properties of fluoride. Regardless, the concentrations of fluoride in oral hygiene products are sufficiently high that fluoride consumption by humans conceivably could have an influence on the spectrum of organisms in oral and gut microbiomes.

The findings reveal that many organisms from all three domains of life carry systems to sense and overcome fluoride toxicity. The pervasive occurrence of these fluoride mitigation systems is consistent with the fact that fluorine is the twelfth most abundant element in the earth's crust. Fluoride riboswitches represent only the second riboswitch class (with TPP riboswitches) to be commonly found in organisms other than bacteria. The widespread distribution of fluoride riboswitches and the genes they control indicates that even the earliest organisms had to contend with fluoride toxicity. Although the fluoride aptamer motif may have been reinvented through evolution in both bacterial and archaeal species, it seems more likely that members of this fluoride riboswitch class were present before the last common ancestor of these two domains. If true, then fluoride-specific riboswitches and commonly associated proteins such as CrcB can represent components of an ancient system by which cells contended with toxic levels of this anion.

TABLE 6

Sequences and alignments of examples of fluoride transporters. The first column lists the GI number for the protein in the NCBI RefSeq database and, following the slash, the amino acids positions of the protein that are aligned in the table.

| | alignment positions 1-50 |
|---|---|
| 94994029/66-396 | AGLVIVFLYDKLGKEVRQGMGLVFQVG.HGQK.D.....QIPPILIPLIL |
| 217422654/69-400 | AGFATGWVYHRVGRSVERGNNLLIDEI.HDPR.A.....IVPTRMAPLVL |
| 53722888/61-392 | AGFATGWVYHRVGRSVERGNNLLIDEI.HDPR.A.....IVPTRMAPLVL |
| 167915998/61-392 | AGFATGWVYHRVGRSVERGNNLLIDEI.HDPR.A.....IVPTRMAPLVL |
| 254208316/69-400 | AGFATGWVYHRVGRSVERGNNLLIDEI.HDPR.A.....IVPTRMAPLVL |
| 254202983/69-400 | AGFATGWVYHRVGRSVERGNNLLIDEI.HDPR.A.....IVPTRMAPLVL |
| 254177294/70-401 | AGFATGWVYHRVGRSVERGNNLLIDEI.HDPR.A.....IVPTRMAPLVL |
| 124381362/70-401 | AGFATGWVYHRVGRSVERGNNLLIDEI.HDPR.A.....IVPTRMAPLVL |
| 134278691/61-392 | AGFATGWVYHRVGRSVERGNNLLIDEI.HDPR.A.....IVPTRMAPLVL |
| 53716487/61-392 | AGFATGWVYHRVGRSVERGNNLLIDEI.HDPR.A.....IVPTRMAPLVL |
| 167002346/61-392 | AGFATGWVYHRVGRSVERGNNLLIDEI.HDPR.A.....IVPTRMAPLVL |
| 126447166/61-392 | AGFATGWVYHRVGRSVERGNNLLIDEI.HDPR.A.....IVPTRMAPLVL |
| 121597200/61-392 | AGFATGWVYHRVGRSVERGNNLLIDEI.HDPR.A.....IVPTRMAPLVL |
| 126442778/69-400 | AGFATGWVYHRVGRSVERGNNLLIDEI.HDPR.A.....IVPTRMAPLVL |
| 28896294/62-392 | AGLVIVFLYDKLGKEVRQGMGLVFQVG.HGQK.D.....QIPPILIPLIL |
| 21910009/62-392 | AGLVIVFLYDKLGKEVRQGMGLVFQVG.HGQK.D.....QIPPILIPLIL |
| 242313952/69-400 | AGFATGWVYHRVGRSVERGNNLLIDEI.HDPR.A.....IVPTRMAPLVL |
| 126458603/69-400 | AGFATGWVYHRVGRSVERGNNLLIDEI.HDPR.A.....IVPTRMAPLVL |
| 76818704/69-400 | AGFATGWVYHRVGRSVERGNNLLIDEI.HDPR.A.....IVPTRMAPLVL |
| 254264654/69-400 | AGFATGWVYHRVGRSVERGNNLLIDEI.HDPR.A.....IVPTRMAPLVL |
| 226195674/69-400 | AGFATGWVYHRVGRSVERGNNLLIDEI.HDPR.A.....IVPTRMAPLVL |
| 237508459/69-400 | AGFATGWVYHRVGRSVERGNNLLIDEI.HDPR.A.....IVPTRMAPLVL |
| 167724759/61-392 | AGFATGWVYHRVGRSVERGNNLLIDEI.HDPR.A.....IVPTRMAPLVL |
| 254186015/61-392 | AGFATGWVYHRVGRSVERGNNLLIDEI.HDPR.A.....IVPTRMAPLVL |
| 167829250/61-392 | AGFATGWVYHRVGRSVERGNNLLIDEI.HDPR.A.....IVPTRMAPLVL |
| 254184798/61-392 | AGFATGWVYHRVGRSVERGNNLLIDEI.HDPR.A.....IVPTRMAPLVL |
| 167850723/61-392 | AGFATGWVYHRVGRSVERGNNLLIDEI.HDPR.A.....IVPTRMAPLVL |
| 167743705/61-392 | AGFATGWVYHRVGRSVERGNNLLIDEI.HDPR.A.....IVPTRMAPLVL |
| 257141781/61-392 | AGFATGWVYHRVGRSVERGNNLLIDEI.HDPQ.A.....IVPKRMAPLVL |
| 167615218/61-392 | AGFATGWVYHRVGRSVERGNNLLIDEI.HDPQ.A.....IVPKRMAPLVL |
| 254194484/61-392 | AGFATGWVYHRVGRSVERGNNLLIDEI.HDPR.A.....IVPTRMAPLVL |
| 167907659/61-392 | AGFATGWVYHRVGRSVERGNNLLIDEI.HDPR.A.....IVPTRMAPLVL |
| 254301074/61-392 | AGFATGWVYHRVGRSVERGNNLLIDEI.HDPR.A.....IVPTRMAPLVL |
| 167923842/61-392 | AGFATGWVYHRVGRSVERGNNLLIDEI.HDPR.A.....IVPTRMAPLVL |
| 167577039/61-392 | AGFATGWVYHRVGRSVERGNNLLIDEI.HDPQ.A.....IVPKRMAPLVL |
| 94990116/66-396 | AGLVIVFLYDKLGKEVRQGMGLVFQVG.HGQK.D.....QIPPILIPLIL |

TABLE 6-continued

Sequences and alignments of examples of fluoride transporters. The first column lists the GI number for the protein in the NCBI RefSeq database and, following the slash, the amino acids positions of the protein that are aligned in the table.

| GI/positions | Sequence |
|---|---|
| 83716137/69-400 | AGFATGWVYHRVGRSVERGNNLLIDEI.HDPQ.A.....IVPKRMAPLVL |
| 94988234/66-396 | AGLVIVFLYDKLGKEVRQGMGLVFQVG.HGQK.D.....QIPPILIPLIL |
| 71903194/66-396 | AGLVIVFLYDKLGKEVRQGMGLVFQVG.HGQK.D.....QIPPILIPLIL |
| 94992108/66-396 | AGLVIVFLYDKLGKEVRQGMGLVFQVG.HGQK.D.....QIPPILIPLIL |
| 306827662/62-392 | AGLVIVFLYDKLGKEVRQGMGLVFQVG.HGQK.D.....QIPPILIPLIL |
| 19745820/62-392 | AGLVIVFLYDKLGKEVRQGMGLVFQVG.HGQK.D.....QIPPILIPLIL |
| 139474077/62-392 | AGLVIVFLYDKLGKEVRQGMGLVFEVG.HGQK.D.....QIPPILIPLIL |
| 71910363/62-392 | AGLVIVFLYDKLGKEVRQGMGLVFQVG.HGQK.N.....QIPPILIPLIL |
| 50913916/66-396 | AGLVIVFLYDKLGKEVRQGMGLVFEVG.HGQK.D.....QISPILIPLIL |
| 209559106/62-392 | AGLVIVFLYDKLGKEVRQGMGLVFQVG.HGQK.N.....QIPPMLIPLIL |
| 15674779/62-392 | AGLVIVFLYDKLGKEVRQGMGLVFQVG.HGQK.N.....QIPPMLIPLIL |
| 167566636/61-392 | AGFATGWIYHRVGQSVERGNNLLIDEI.HDPQ.R.....IVPKRMAPLVL |
| 167573712/61-392 | AGFATGWIYHRVGQSVERGNNLLIDEI.HDPQ.R.....IVPKRMAPLVL |
| 251782109/62-392 | AGLVIVFLYDKLGKEVRQGMGLVFQVG.HGQK.N.....QIPPILIPLIL |
| 66768521/61-392 | AGFGVGLVYHLLGKDVDAGNNLIIDEI.HDPR.K.....TLPLRMAPLVL |
| 21231425/61-392 | AGFGVGLVYHLLGKDVDAGNNLIIDEI.HDPR.K.....TLPLRMAPLVL |
| 188991670/81-412 | AGFGVGLVYHLLGKDVDAGNNLIIDEI.HDPR.K.....TLPLRMAPLVL |
| 221210981/61-392 | AGFATGWVYHRFGQPVARGNNLLIDEI.HDPK.A.....LVPKRMAPLVL |
| 189352355/61-392 | AGFATGWVYHRFGQPVARGNNLLIDEI.HDPK.A.....LVPKRMAPLVL |
| 161521476/61-392 | AGFATGWVYHRFGQPVARGNNLLIDEI.HDPK.A.....LVPKRMAPLVL |
| 221203824/61-392 | AGFATGWVYHRFGQPVARGNNLLIDEI.HDPR.A.....LVPKRMAPLVL |
| 221197152/61-392 | AGFATGWVYHRFGQPVARGNNLLIDEI.HDPR.A.....LVPKRMAPLVL |
| 77408502/58-387 | .GLFIVFVYQKFGGKSVKGMGLVFEVG.HGNE.E.....TIPKRLVPLVI |
| 167583829/60-391 | AGFATCWIYHRFGQSVARGNNLLIDEI.HDPK.A.....LVPKRMAPLVL |
| 77411121/58-387 | .GLFIVFVYQKFGGKSVKGMGLVFEVG.HGNE.E.....TIPKRLVPLVI |
| 76798380/58-387 | .GLFIVFVYQKFGGKSVKGMGLVFEVG.HGNE.E.....TIPKRLVPLVI |
| 76787827/58-387 | .GLFIVFVYQKFGGKSVKGMGLVFEVG.HGNE.E.....TIPKRLVPLVI |
| 25010655/58-387 | .GLFIVFVYQKFGGKSVKGMGLVFEVG.HGNE.E.....TIPKRLVPLVI |
| 22536719/58-387 | .GLFIVFVYQKFGGKSVKGMGLVFEVG.HGNE.E.....TIPKRLVPLVI |
| 170701178/116-447 | AGFATGWVYHRFGQSVARGNNLLIDEI.HDPK.A.....LVPKRMAPLVL |
| 134292888/61-392 | AGFATGWVYHRFGQSVARGNNLLIDEI.HDPK.A.....LVPKRMGPLVL |
| 115360262/61-392 | AGFATGWVYHRFGQSVARGNNLLIDEI.HDPK.A.....LVPKRMAPLVL |
| 172062717/116-447 | AGFATGWVYHRFGQSVARGNNLLIDEI.HDPK.A.....LVPKRMAPLVL |
| 170736113/61-392 | AGFATGWVYHRFGQSVARGNNLLIDEI.HDPK.A.....LVPKRMAPLVL |
| 254248860/130-461 | AGFATGWVYHRFGQSVARGNNLLIDEI.HDPK.A.....LVPKRMAPLVL |
| 206562684/116-447 | AGFATGWVYHRFGQSVARGNNLLIDEI.HDPK.A.....LVPKRMAPLVL |
| 116691890/61-392 | AGFATGWVYHRFGQSVARGNNLLIDEI.HDPK.A.....LVPKRMAPLVL |

TABLE 6-continued

Sequences and alignments of examples of fluoride transporters. The first column lists the GI number for the protein in the NCBI RefSeq database and, following the slash, the amino acids positions of the protein that are aligned in the table.

| GI/positions | Sequence |
|---|---|
| 107026913/61-392 | AGFATGWVYHRFGQSVARGNNLLIDEI.HDPK.A.....LVPKRMAPLVL |
| 78063149/61-392 | AGFATGWIYHRFGQSVARGNNLLIDEI.HDPK.A.....LVPKRMAPLVL |
| 224824608/61-392 | AGFGVGWLYLRFGQRVEAGNNLLIDEI.HDPK.R.....VIPLRMAPLVL |
| 300697592/50-381 | AGLAVGLLYHYAGRSVEGGNNLLIDEI.HDPK.R.....IVPKRMAPLIL |
| 187925675/61-392 | AGFATGWVYHRVGKPVEGGNNLLIDEI.HDPQ.K.....IVPKRMAPLVL |
| 160897178/61-392 | AGMAVGLVYFLLGKRVDGGNNLLIEEI.HDPK.Q.....VIPLRMAPLVL |
| 207739311/50-381 | AGLAVGLLYHYAGRSVEGGNNLLIDEI.HDPK.R.....IVPKRMAPLIL |
| 300311782/61-392 | GGFAVGWLYLHTGKPVEAGNNLLIDEI.HDPR.K.....VIPLRMAPLVL |
| 83748726/62-393 | AGLAVGLLYHYAGRSVEGGNNLLIDEI.HDPK.R.....IVPKRMAPLIL |
| 17546522/50-381 | AGLAVGLLYHYTGRAVEGGNNLLIDEI.HDPK.R.....VVPKRMAPLIL |
| 207724636/50-381 | AGLAVGLLYHYAGRSVEGGNNLLIDEI.HDPK.R.....IVPKRMAPLIL |
| 166712100/61-392 | AGFAVGLVYLLLGKQVDAGNNLIIDEI.HDPK.K.....LVPLRMAPLVM |
| 84624054/61-392 | AGFAVGLVYLLLGKQVDAGNNLIIDEI.QDPK.K.....LVPLRMAPLVM |
| 58582162/61-392 | AGFAVGLVYLLLGKQVDAGNNLIIDEI.QDPK.K.....LVPLRMAPLVM |
| 188576912/61-392 | AGFAVGLVYLLLGKQVDAGNNLIIDEI.QDPK.K.....LVPLRMAPLVM |
| 188576721/61-392 | AGFAVGLVYLLLGKQVDAGNNLIIDEI.QDPK.K.....LVPLRMAPLVM |
| 237728386/61-392 | AGLLVGLVYSWYGEPVNAGNNLIIDEI.HDPR.K.....VVPIRMVPLVL |
| 34497884/61-392 | GGFAVGMAYLRLGKEVEGGNNLLIDEI.HDPQ.K.....TVPLRMVPLVL |
| 285018239/61-392 | AGFGVGLVYHLLGKVVDGGNNLIIEEI.HDPK.Q.....VVPLRMAPLVL |
| 66044733/61-398 | AGFAVGLAYHLIGKPVDAGNNLIIDEI.HDPK.K.....IVPLRMVPMVL |
| 213971827/61-398 | AGFAVGLAYHLIGKPVDAGNNLIIDEI.HDPK.K.....IVPLRMVPMVL |
| 171058747/61-392 | AGFAVGWVYLKVGRGVEAGNNLIIDEI.HDPK.N.....VVPLRMAPLIL |
| 238025034/95-426 | AGFATGWFYLRFGSAVEGGNNLLIDEI.HDPA.R.....AVPTRMAPLVM |
| 229589423/61-398 | AGFAVGLAYHLIGKPVDAGNNLIIDEI.HDPK.K.....TIPLRMVPMVL |
| 300693842/50-381 | AGLAVGLLYHYTGHAVEGGNNLLIDEI.HDPK.R.....IVPKRMAPLIL |
| 28871751/65-402 | AGFAVGLAYHLIGKPVDAGNNLIIDEI.HDPK.K.....IVPLRMVPMVL |
| 237801960/61-398 | AGFAVGLAYHLIGKPVDAGNNLIIDEI.HDPK.K.....IVPLRMVPMVL |
| 241665656/62-393 | AGLAVGLLYHYTGRSVEGGNNLLIDEI.HDPK.R.....VVPKRMAPLIL |
| 187926168/62-393 | AGLAVGLLYHYTGRSVEGGNNLLIDEI.HDPK.R.....VVPKRMAPLIL |
| 302059036/73-410 | AGFAVGLAYHLIGKPVDAGNNLIIDEI.HDPK.K.....IVPLRMVPMVL |
| 309779037/62-393 | AGLAVGLLYHYTGRSVEGGNNLLIDEI.HDPK.R.....IVPKRVAPLIL |
| 126698234/62-390 | .GVVIAYCYFKFGGKSSKGMNLIFEVG.HGEE.E.....IIPLRLVPFII |
| 306519283/74-402 | .GVVIAYCYFKFGGKSSKGMNLIFEVG.HGEE.E.....IIPLRLVPFII |
| 260685949/74-402 | .GVVIAYCYFKFGGKSSKGMNLIFEVG.HGEE.E.....IIPLRLVPFII |
| 260682350/74-402 | .GVVIAYCYFKFGGKSSKGMNLIFEVG.HGEE.E.....IIPLRLVPFII |
| 255649173/74-402 | .GVVIAYCYFKFGGKSSKGMNLIFEVG.HGEE.E.....IIPLRLVPFII |
| 255516076/74-402 | .GVVIAYCYFKFGGKSSKGMNLIFEVG.HGEE.E.....IIPLRLVPFII |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 255313389/74-402 | .GVVIAYCYFKFGGKSSKGMNLIFEVG.HGEE.E.....IIPLRLVPFII |
| 255091661/74-402 | .GVVIAYCYFKFGGKSSKGMNLIFEVG.HGEE.E.....IIPLRLVPFII |
| 254974264/74-402 | .GVVIAYCYFKFGGKSSKGMNLIFEVG.HGEE.E.....IIPLRLVPFII |
| 225868779/61-391 | AGLVIVFLYEQYGQIAKQGMGLVFDVG.HGEK.T.....RLPLVLIPLII |
| 255099763/74-402 | .GVVIAYCYFKFGGKSSKGMNLIFEVG.HGEE.E.....IIPLRLVPFII |
| 255305648/74-402 | .GVVIAYCYFKFGGKSSKGMNLIFEVG.HGEE.E.....IIPLRLVPFII |
| 225870265/61-391 | AGLVIVFLYEQYGQIAKQGMGLVFDVG.HGEK.T.....RLPLVLIPLII |
| 296878238/74-402 | .GVVIAYCYFKFGGKSSKGMNLIFEVG.HGEE.E.....IIPLRLIPFII |
| 296449441/74-402 | .GVVIAYCYFKFGGKSSKGMNLIFEVG.HGEE.E.....IIPLRLIPFII |
| 255654699/74-402 | .GVVIAYCYFKFGGKSSKGMNLIFEVG.HGEE.E.....IIPLRLIPFII |
| 296876619/58-390 | AGFVIVYLYKRFGGKASKGMGLIFDVG.HARE.E.....EIPLVLVPLIM |
| 163790421/57-388 | AGLIIVYMYKKIGKNTNKGMSLVFSAG.NEEL.H.....EIPKRMIPLTI |
| 24379705/63-392 | AGLIIVYLYQKWGAKSSKGMGLIFQVG.FEEE.D.....HIPKRLIPMVI |
| 290580296/63-392 | AGLIIVYLYQKWGAKSSKGMGLIFQVG.FEEE.D.....HIPKRLIPMVI |
| 171780017/63-391 | .GLVIVFLYQKADSRASKGMGLLFAVS.QGDE.K.....KIPLVMLPLVT |
| 261407611/66-398 | GGAAVSFLYYKFGKSSAKGNNLILEQI.HGGT.E.....SIPLRMAPLVL |
| 299137255/65-396 | AGVLVGLMYHYFGRSVEAGNNLLLDEI.HDPK.A.....VIPFRMTPLIL |
| 237668509/58-389 | AGVAIVYIYNKIGKNSIKGMTLVFESA.DKED.A.....VIPKRLIPLTI |
| 182416531/58-389 | AGVAIVYIYNKIGKNSIKGMTLVFESA.DKED.A.....VIPKRLIPLTI |
| 288905673/63-391 | .GLLIVFLYQKADERASKGMGLVFAVG.QSQE.K.....EIPLILVPLVT |
| 306831767/63-391 | .GLLIVFLYQKADERTSKGMGLVFAVG.QSQE.K.....EIPLILVPLVT |
| 125624281/58-389 | AGLLIVYLYKNFGKDSQKGMGLIFEAG.NHGR.E.....DIPKRLVPLIV |
| 306833893/72-400 | .GLLIVFLYQKADERVSKGMGLVFAIG.QSQE.K.....EIPLILVPLVT |
| 24379706/63-391 | AGLLIVFIYDHFGGKSIKGMSLVFDVA.DERE.V.....TIPKRLVPLAI |
| 223936158/62-409 | GGVAVGLLYHWLGREAEKGSNLIIDEI.HKPG.G.....GVPRRMAPLVL |
| 168216344/69-400 | GGALVSFLYYKFGRNSVKGNNLIIENI.NNYC.G.....DVPLRMVPLVF |
| 281491597/58-389 | AGLLIVYIYKNFGKDSQKGMGLIFEAG.NHGR.E.....DIPKRLVPLII |
| 116627914/63-392 | AGLLIVYLYQKFAGKTAQGMGLIFKVG.HNEE.D.....QVPLRLIPLVT |
| 290580295/63-391 | AGLLIVFIYDHFGGKSIKGMSLVFDVA.DERE.V.....TIPKRLVPLAI |
| 15673080/58-389 | AGLLIVYIYKNFGKDSQKGMGLIFEAG.NHGR.E.....DIPKRLVPLIV |
| 116511937/58-389 | AGLLIVYLYKNFGKDSQKGMGLIFEAG.NHGR.E.....DIPKRLVPLIV |
| 257874163/61-390 | .GICFTYLFQKYGDRSPQGMNLVFLVG.QEEE.K.....DIPLRLIPFVM |
| 257867835/61-390 | .GICFTYLFQKYGDRSPQGMNLVFLVG.QEEE.K.....DIPLRLIPFVM |
| 55821189/63-392 | AGLLIVYLYQKFAGKAAQGMGLIFKVG.HNEE.D.....QVPLRLIPLVT |
| 182626550/69-400 | GGALVSFLYYKFGRNSVKGNNLIIENI.NNYC.G.....DVPLRMVPLVF |
| 110803970/69-400 | GGALVSFLYYKFGRNSVKGNNLIIENI.NNYC.G.....DVPLRMVPLVF |
| 55823099/63-392 | AGLLIVYLYQKFAGKAAQGMGLIFKVG.HNEE.D.....QVPLRLIPLVT |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 209544766/77-424 | AGVAVGLTYHVLGRQAEGGNNLIVDQI.HEPG.G.....GVPLRMAPLVL |
| 169343074/69-400 | GGALVSFLYYKFGRNSVKGNNLIIENI.NDYC.G.....DVPLRMVPLVF |
| 110800437/69-400 | GGALVSFLYYKFGRNSVKGNNLIIENI.NNYC.G.....DVPLRMVPLVF |
| 168210325/69-400 | GGALVSFLYYKFGRNSVKGNNLIIENI.NNYC.G.....DVPLRMVPLVF |
| 253755995/54-382 | AGVLIVFIYQKWGREVQAGMGLVFKAG.QGEK.A.....QISPVLIPLII |
| 253754061/54-382 | AGVLIVFIYQKWGREVQAGMGLVFKAG.QGEK.A.....QISPVLIPLII |
| 253752235/54-382 | AGVLIVFIYQKWGREVQAGMGLVFKAG.QGEK.A.....QISPVLIPLII |
| 146321395/54-382 | AGVLIVFIYQKWGREVQAGMGLVFKAG.QGEK.A.....QISPVLIPLII |
| 146319191/54-382 | AGVLIVFIYQKWGREVQAGMGLVFKAG.QGEK.A.....QISPVLIPLII |
| 256423027/87-434 | AGILIHFLYKKLGGTSEAGNNLIMDEI.HEPG.G.....GVPARMAPLVI |
| 168207393/69-400 | GGALVSFLYYKFGRNSVKGNNLIIENI.NNYC.G.....DVPLRMVPLVF |
| 168214512/69-400 | GGALVSFLYYKFGRNSVKGNNLIIENI.NNYC.G.....DVPLRMVPLVF |
| 18309572/69-400 | GGALVSFLYYKFGRNSVKGNNLIIENI.NNYC.G.....DVPLRMVPLVF |
| 162149525/77-424 | AGVAVGLTYHVLGRQAEGGNNLIVDQI.HEPG.G.....GVPLRMAPLVL |
| 196229369/63-411 | AGVAVGLLYHYYGRSAEGGNNLIMDQI.HEPG.G.....GVPRRMAPLVL |
| 257876728/61-390 | .GICFTYLFQKYGDRSPQGMNLVFLVG.QEEE.K.....DIPLRLIPFVM |
| 251797520/69-399 | .GALMSFFYWKHGKNAGKGNNLILEQI.RQGQ.E.....TIPFRMAPLVL |
| 195977885/1-309 | ......................MFDVG.HGEK.A.....KLPLVLIPLII |
| 222152807/62-391 | GGLLIVYLYNRFGGKAKAGMGLIFDVG.HAQE.E.....DIPLVLIPLVI |
| 59710638/60-408 | AGLAIVYSYRNWGKNSAGGNNLIMDEI.HQAG.E.....GVPVRMGPLVL |
| 167766061/56-388 | AGFVITAIYYVFSKLSLKGMKLVFEVG.QQKT.D.....SIPLLLIPLVM |
| 228476400/63-392 | AGLLIVYLYQKFAGKAAQGMGLIFKVG.HNEE.D.....QVPLRLIPLVT |
| 197334244/60-408 | AGLAIVYSYRNWGKNSAGGNNLIMDEI.HQAG.E.....GVPVRMGPLVL |
| 284005894/64-409 | .GVLILWLYQKGGKNAERGNNLLIDEI.HQPG.G.....GVPGRMAPLVL |
| 95928333/62-409 | AGIFIVWCYHSMGSTAGGGNNLVMEQI.HQPG.A.....GIPKRMMPLVL |
| 307277103/61-391 | .GVVFTYFYTRFGKNASRGNNLVIEQG.NSGE.E.....DIPLRLIPLTL |
| 171911999/62-407 | GGLLVGLLYHFWGRGSDKGNNLILEEI.HAPG.G.....GVPGRMAPLVL |
| 257421896/61-391 | .GVVFTYFYTRFGKNASRGNNLVIEQG.NGGE.E.....DIPLRLIPLTL |
| 300779490/57-408 | AGLLIHFLYQSVGKSSEKGNNLIMDEI.HQPG.G.....GVPKRMAPIVL |
| 257416700/61-391 | .GVVFTYFYTRFGKNASRGNNLVIEQG.NGGE.E.....DIPLRLIPLTL |
| 307271571/61-391 | .GVVFTYFYTRFGKNASRGNNLVIEQG.NGGE.E.....DIPLRLIPLTL |
| 300860446/61-391 | .GVVFTYFYTRFGKNASRGNNLVIEQG.NGGE.E.....DIPLRLIPLTL |
| 257419916/61-391 | .GVVFTYFYTRFGKNASRGNNLVIEQG.NGGE.E.....DIPLRLIPLTL |
| 256963630/61-391 | .GVVFTYFYTRFGKNASRGNNLVIEQG.NGGE.E.....DIPLRLIPLTL |
| 256956740/61-391 | .GVVFTYFYTRFGKNASRGNNLVIEQG.NGGE.E.....DIPLRLIPLTL |
| 255972070/61-391 | .GVVFTYFYTRFGKNASRGNNLVIEQG.NGGE.E.....DIPLRLIPLTL |
| 229549364/61-391 | .GVVFTYFYTRFGKNASRGNNLVIEQG.NGGE.E.....DIPLRLIPLTL |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 149280114/62-411 | AGIVIHLIYQSVGRSSEKGNNLIMDEI.HRPG.G.....GVPRQMAPVIL |
| 307290483/61-391 | .GVVFTYFYTRFGKNASRGNNLVIEQG.NGGE.E.....DIPLRLIPLTL |
| 256853823/61-391 | .GVVFTYFYTRFGKNASRGNNLVIEQG.NGGE.E.....DIPLRLIPLTL |
| 256616980/61-391 | .GVVFTYFYTRFGKNASRGNNLVIEQG.NGGE.E.....DIPLRLIPLTL |
| 229545116/61-391 | .GVVFTYFYTRFGKNASRGNNLVIEQG.NGGE.E.....DIPLRLIPLTL |
| 257081959/61-391 | .GVVFTYFYTRFGKNASRGNNLVIEQG.NGGE.E.....DIPLRLIPLTL |
| 307285753/61-391 | .GVVFTYFYTRFGKNASRGNNLVIEQG.NGGE.E.....DIPLRLIPLTL |
| 255975137/61-391 | .GVVFTYFYTRFGKNASRGNNLVIEQG.NGGE.E.....DIPLRLIPLTL |
| 257090652/61-391 | .GVVFTYFYTRFGKNASRGNNLVIEQG.NGGE.E.....DIPLRLIPLTL |
| 256763156/61-391 | .GVVFTYFYTRFGKNASRGNNLVIEQG.NGGE.E.....DIPLRLIPLTL |
| 29376957/61-391 | .GVVFTYFYTRFGKNASRGNNLVIEQG.NGGE.E.....DIPLRLIPLTL |
| 227553996/61-391 | .GVVFTYFYTRFGKNASRGNNLVIEQG.NGGE.E.....DIPLRLIPLTL |
| 307287657/61-391 | .GVVFTYFYTRFGKNASRGNNLVIEQG.NGGE.E.....DIPLRLIPLTL |
| 293387361/61-391 | .GVVFTYFYTRFGKNASRGNNLVIEQG.NGGE.E.....DIPLRLIPLTL |
| 293383526/61-391 | .GVVFTYFYTRFGKNASRGNNLVIEQG.NGGE.E.....DIPLRLIPLTL |
| 256961242/61-391 | .GVVFTYFYTRFGKNASRGNNLVIEQG.NGGE.E.....DIPLRLIPLTL |
| 300731132/63-397 | AGWLVGEMYKRLGTSVEAGNNLILEEI.HSPT.A.....TIPVRMTPLIL |
| 257087493/61-391 | .GVVFTYFYTRFGKNASRGNNLVIEQG.NGGE.E.....DIPLRLIPLTL |
| 307270777/61-391 | .GVVFTYFYTRFGKNASRGNNLVIEQG.NGGE.E.....DIPLRLIPLTL |
| 294780852/61-391 | .GVVFTYFYTRFGKNASRGNNLVIEQG.NGGE.E.....DIPLRLIPLTL |
| 257079694/61-391 | .GVVFTYFYTRFGKNASRGNNLVIEQG.NGGE.E.....DIPLRLIPLTL |
| 222086761/62-408 | AGFLMVLAYQRFGRGAEGGNNLIVEQI.HEPG.G.....GVPLRMAPFIL |
| 257084511/61-391 | .GVVFTYFYTRFGKNASRGNNLVIEQG.NGGE.E.....DIPLRLIPLTL |
| 240137886/73-417 | GGFAVGLLYFLFGKSVEGGNNLIVEEI.HEPD.G.....GVPLRMTPLIF |
| 302024216/54-382 | AGGVIVFIYQKWGREVQAGMGLVFKAG.QGEK.A.....QISPVLIPLII |
| 222147858/69-416 | AGFAMVWAYQRFGKAAEGGNNLIVEQI.HEPG.G.....GVPLRMAPFIL |
| 293559774/61-391 | .GALFAYLYAYHGGLSSRGNNLVIDQG.NGGE.E.....KIPLRLIPLTL |
| 260558935/61-391 | .GALFAYLYAYHGGLSSRGNNLVIDQG.NGGE.E.....KIPLRLIPLTL |
| 257890482/61-391 | .GALFAYLYAYHGGLSSRGNNLVIDQG.NGGE.E.....KIPLRLIPLTL |
| 154484719/61-393 | AGLFIVWMYSYFSKVSLKGMTLVFEAG.QNKR.D.....SIPMALVPLVM |
| 227519818/61-391 | .GVVFTYFYTRFGKNAGRGNNLVIEQG.NGGE.E.....DIPLRLIPLTL |
| 86143630/67-398 | GGFLVGLSYHLYGNSVVKGNNLLLEEF.HTPK.K.....VIPFKMAPLVL |
| 293568623/61-391 | .GALFAYLYAYHGGLSSRGNNLVIDQG.NGGE.E.....KIPLRLIPLTL |
| 251778279/66-397 | GGALVSFLYSKYGKSSSRGNNLIIEKI.NTSN.G.....EIPLRMASLVF |
| 257886896/61-391 | .GALFAYLYAYHGGLSSRGNNLVIDQG.NGGE.E.....KIPLRLIPLTL |
| 188588504/66-397 | GGALVSFLYSKYGKSSSRGNNLIIEKI.NTSN.G.....EIPLRMASLVF |
| 293571654/61-391 | .GALFAYLYAYHGGLSSRGNNLVIDQG.NGGE.E.....KIPLRLIPLTL |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 300863903/61-393 | AGFLSGWIYHQYGKQVEAGNNLLLEEI.HNPK.N.....IIPLRMAPMVL |
| 257895467/61-391 | .GALFAYLYAYHGGLSSRGNNLVIDQG.NGGE.E.....NIPLRLIPLTL |
| 257898081/61-391 | .GALFAYLYAYHGGLSSRGNNLVIDQG.NGGE.E.....KIPLRLIPLTL |
| 69249390/61-391 | .GALFAYLYAYHGGLSSRGNNLVIDQG.NGGE.E.....KIPLRLIPLTL |
| 258614354/61-391 | .GALFAYLYAYHGGLSSRGNNLVIDQG.NGGE.E.....KIPLRLIPLTL |
| 257893085/61-391 | .GALFAYLYAYHGGLSSRGNNLVIDQG.NGGE.E.....KIPLRLIPLTL |
| 257879974/61-391 | .GALFAYLYAYHGGLSSRGNNLVIDQG.NGGE.E.....KIPLRLIPLTL |
| 294053809/63-411 | .GVGIVWLYRRFGKNSEAGNNLIMDEI.HTPG.G.....GIPFRMAPLVL |
| 149275805/8-356 | .GILIHFIYQSVGKSSEKGNNLIIEEI.HQPG.G.....GVPIQMAPIVL |
| 293553829/61-391 | .GALFAYLYAYHGGLSSRGNNLVIDQG.NGGE.E.....KIPLRLIPLTL |
| 224023708/79-410 | AGLLIGLMYHYLAGTAARGNNYLIEEI.RSPH.D.....IIPFRMAPLVY |
| 294623042/61-391 | .GALFAYLYAYHGGLSSRGNNLVIDQG.NGGE.E.....KIPLRLIPLTL |
| 289567585/61-391 | .GALFAYLYAYHGGLSSRGNNLVIDQG.NGGE.E.....KIPLRLIPLTL |
| 261209457/61-391 | .GALFAYLYAYHGGLSSRGNNLVIDQG.NGGE.E.....KIPLRLIPLTL |
| 257884112/61-391 | .GALFAYLYAYHGGLSSRGNNLVIDQG.NGGE.E.....KIPLRLIPLTL |
| 189460046/67-398 | AGLVIGLMYHYLAGTASRGNNFLIEEI.RSPH.D.....IIPFRMAPLVY |
| 294620207/61-391 | .GALFAYLYAYHGGLSSRGNNLVIDQG.NGGE.E.....KIPLRLIPLTL |
| 118579274/62-407 | AGAAISLLYSRIGNGAEGGNNLLMDAI.HGSE.NGDSGIVVPRRMAPLIL |
| 58040573/61-408 | AGVAVGLCYFWFGRDVEAGANLIVDEI.HEPG.A.....GVQLRMAPFVL |
| 187932697/74-404 | .GAFVSFLYSKYGKSSSKGNNLIIDKI.NTNN.G.....NIPMRMASLVF |
| 293378332/61-391 | .GALFAYLYAYHGGLSSRGNNLVIDQG.NGGE.E.....NIPLRLIPLTL |
| 296115670/62-409 | AGVGVGLTYHHLGRCAEGGNNLIIDQI.HEPG.G.....GVPLRMAPLVL |
| 227551941/85-415 | .GALFAYLYAYHGGLSSRGNNLVIDQG.NGGE.E.....NIPLRLIPLTL |
| 294616356/61-391 | .GALFAYLYAYYGGLSSRGNNLVIDQG.NGGE.E.....KIPLRLIPLTL |
| 257883083/61-391 | .GALFAYLYAYHGGLSSRGNNLVIDQG.NGGE.E.....KIPLRLITLTL |
| 253771312/60-391 | GGVLVSFLYYKYGSNSSKGNNLIIEKI.NEGC.E.....DIPLRMTPLVF |
| 225166826/60-391 | GGVLVSFLYYKYGSNSSKGNNLIIEKI.NEGC.E.....DIPLRMTPLVF |
| 307688608/69-400 | AGAFVSFLYSKYGKTSSQGNNLILDQI.HGGD.N.....GIPLRMAPLVF |
| 302873225/69-400 | AGAFVSFLYSKYGKTSSQGNNLILDQI.HGGD.N.....GIPLRMAPLVF |
| 87306694/62-420 | AGIASGLMYHYLGREAEAGNNLIMEQI.HQPG.G.....GVPLRMAPLVL |
| 88801314/65-397 | GGLFIGLSYHYYGESVVKGNNLLLEEY.HTPK.K.....TIPFKMVPLVF |
| 218283679/62-391 | AGLAIVFLFDHWGRISRKGMGLVFEVD.QGKS.D.....WIPLRMAPFMV |
| 240146274/81-413 | AGLLITWLYYHFSETSLKGMTLVFETG.QKKR.E.....DIPLLIPLVM |
| 197301848/54-386 | AGLLIVWMYHRFSEESLKGMTLVLETG.QKKR.K.....SIPLALVPLVI |
| 198275782/67-397 | AGLLIGLMYHYWAGTASRGNNYLIEEI.RSPH.D.....IIPFRMAPLVY |
| 304404790/58-390 | GGAFISWLYMRYGGAAAKGNNLILEQSYEAPE.V.....RVPLRMGPLVL |
| 227540545/49-380 | GGLSVGLLYYYWGKDVEAGNNLLIDTI.HTPE.Q.....TIPFKMAPFVY |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 260771568/62-409 | .GLGLVFFYRQWGGISERGNNLIIDQI.HQSN.E.....KIPFRMSVFVL |
| 307818395/70-401 | AGFSVGLLYRHFGSKVEGGNALILEEI.HDPQ.E.....TISLRMTPLIL |
| 300771325/49-380 | GGLSVGLLYYYWGKDVEAGNNLLIDTI.HKPE.Q.....TIPFKMAPFVY |
| 283796370/78-411 | AGVLSVYLYRTFGEKCARGMGLAFEVG.FGTE.K.....EIPLRLIPLVT |
| 300778780/74-405 | AGFLIGLLYYYFGKDVEAGNNLLIDTI.HEPK.G.....IIPFKMAPFVY |
| 283856276/78-422 | AGFITSWLYSRYGKLAAGGNNLILEEI.HKPN.A.....GVPLRMAPLIF |
| 260752944/61-405 | AGFITSWFYSRYGKLAAGGNNLILEEI.HKPN.A.....GVPLRMAPLIF |
| 281418863/57-387 | AGVFITWCYNRFGSDSAKGMALLFEIH.QDKR.S.....SIPLRLIPFAV |
| 241761090/61-405 | AGFITSWLYSRYGKLAAGGNNLILEEI.HKPN.V.....GVPLRMAPLIF |
| 255533420/59-389 | AGLVIGFVYHHKGKGVERGNNLIFDTV.HNPA.A.....IIPFKMVPLVL |
| 256004137/57-387 | AGVFITWCYNRFGSDSAKGMALLFEIH.QDKR.S.....SIPLRLIPFAV |
| 251796733/53-386 | GGALVSWLYMQYGKDAAKGNNLLLDRI.YGGE.T.....AVPLRMAPLVL |
| 125974665/60-390 | AGVFITWCYNRFGNDSAKGMALLFEIH.QDKR.S.....SIPLRLIPFAV |
| 293374935/63-394 | GGAFVSYLYLKFGKDSAKGNNLIIERI.NEGV.G.....EIPFRMAPLVF |
| 149197279/60-400 | GGLCIGLIYHYLGQNVVKGNNQLLDEI.IQPK.K.....IIPLRMAPLVA |
| 260584530/57-386 | .GFLFHTVYLKYGKNAVEGMNIVFRIG.QGED.N.....RISKWLIPFMM |
| 159897555/58-389 | .GGLVAWLYQRFGTSVAAGNNLIIEQL.HNPDSA.....GIPLRMAPLVL |
| 108757317/55-387 | AGLVLGAVYGKWGRPIRGGNNLVLDTV.HASD.A.....QVPVRMAPMVL |
| 310817431/55-387 | AGLAVGALYARWGSSIRGGNNLVLDTV.HEGD.R.....QIPLRMAPLVL |
| 126645925/55-387 | GGFLIGWTYYKYAESSVKGNNLLLEEL.YQSK.S.....PIPLRMTPLVL |
| 115376569/2-329 | .....GALYARWGSSIRGGNNLVLDTV.HEGD.R.....QIPLRMAPLVL |
| 153853007/62-402 | GGVFIWFIYHQFGKSVANGMKMVFHVG.LGKN.T.....KLPIRMVPLSV |
| 189911881/62-391 | .GFFIGWVYHQFGSKASKGNNLLLEEI.HSPS.S.....VIPIRMAPLVL |
| 183221808/62-391 | .GFFIGWVYHQFGSKASKGNNLLLEEI.HSPS.S.....VIPIRMAPLVL |
| 146300126/58-389 | GGLLVGLSYYYWGESVVKGNNLLLEEY.EKPK.K.....VIPFKMAPLVL |
| 283779250/63-421 | AGVLVALAYQRLCPQAEAGNNLLLEEI.HEPA.A.....GVPLWMAPLVL |
| 289639619/53-382 | .GVFTVFLYTRFGKNAQRGNNLIIDSV.NE.N.E.....QVPLRMGIFTF |
| 296122614/61-407 | .GAISAWLYLFFGREAGQGNNLVIAEI.QHPM.K.....GLPWFMAPLIV |
| 241888810/58-377 | ..........YLHTSAIGMKYFIEAA.TDKK.E.....KVTWEFPFLLT |
| | .................................................... |
| | alignment positions 51-100 |
| 94994029/66-396 | FSTWVTHLFGASAGREGVAVQIGATISHYCQRFVT.S....QEAARHLLI |
| 217422654/69-400 | VATVVTHLFGGSAGREGTAVQMGGALADRVTQLVG.LD...RDARRIMLM |
| 53722888/61-392 | VATVVTHLFGGSAGREGTAVQMGGALADRVTQLVG.LD...RDARRIMLM |
| 167915998/61-392 | VATVVTHLFGGSAGREGTAVQMGGALADRVTQLVG.LD...RDARRIMLM |
| 254208316/69-400 | VATVVTHLFGGSAGREGTAVQMGGALADRVTQLVG.LD...RDARRIMLM |
| 254202983/69-400 | VATVVTHLFGGSAGREGTAVQMGGALADRVTQLVG.LD...RDARRIMLM |
| 254177294/70-401 | VATVVTHLFGGSAGREGTAVQMGGALADRVTQLVG.LD...RDARRIMLM |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 124381362/70-401 | VATVVTHLFGGSAGREGTAVQMGGALADRVTQLVG.LD...RDARRIMLM |
| 134278691/61-392 | VATVVTHLFGGSAGREGTAVQMGGALADRVTQLVG.LD...RDARRIMLM |
| 53716487/61-392 | VATVVTHLFGGSAGREGTAVQMGGALADRVTQLVG.LD...RDARRIMLM |
| 167002346/61-392 | VATVVTHLFGGSAGREGTAVQMGGALADRVTQLVG.LD...RDARRIMLM |
| 126447166/61-392 | VATVVTHLFGGSAGREGTAVQMGGALADRVTQLVG.LD...RDARRIMLM |
| 121597200/61-392 | VATVVTHLFGGSAGREGTAVQMGGALADRVTQLVG.LD...RDARRIMLM |
| 126442778/69-400 | VATVVTHLFGGSAGREGTAVQMGGALADRVTQLVG.LD...RDARRIMLM |
| 28896294/62-392 | LSTWVTHLFGASAGREGVAVQIGATISHYCRRFVT.S....QEAARHLLI |
| 21910009/62-392 | LSTWVTHLFGASAGREGVAVQIGATISHYCRRFVT.S....QEAARHLLI |
| 242313952/69-400 | VATVVTHLFGGSAGREGTAVQMGGALADRVTQLVG.LD...RDARRIMLM |
| 126458603/69-400 | VATVVTHLFGGSAGREGTAVQMGGALADRVTQLVG.LD...RDARRIMLM |
| 76818704/69-400 | VATVVTHLFGGSAGREGTAVQMGGALADRVTQLVG.LD...RDARRIMLM |
| 254264654/69-400 | VATVVTHLFGGSAGREGTAVQMGGALADRVTQLVG.LD...RDARRIMLM |
| 226195674/69-400 | VATVVTHLFGGSAGREGTAVQMGGALADRVTQLVG.LD...RDARRIMLM |
| 237508459/69-400 | VATVVTHLFGGSAGREGTAVQMGGALADRVTQLVG.LD...RDARRIMLM |
| 167724759/61-392 | VATVVTHLFGGSAGREGTAVQMGGALADRVTQLVG.LD...RDARRIMLM |
| 254186015/61-392 | VATVVTHLFGGSAGREGTAVQMGGALADRVTQLVG.LD...RDARRIMLM |
| 167829250/61-392 | VATVVTHLFGGSAGREGTAVQMGGALADRVTQLVG.LD...RDARRIMLM |
| 254184798/61-392 | VATVVTHLFGGSAGREGTAVQMGGALADRVTQLVG.LD...RDARRIMLM |
| 167850723/61-392 | VATVVTHLFGGSAGREGTAVQMGGALADRVTQLVG.LD...RDARRIMLM |
| 167743705/61-392 | VATVVTHLFGGSAGREGTAVQMGGALADRVTQLVG.LD...RDARRIMLM |
| 257141781/61-392 | VATVVTHLFGGSAGREGTAVQMGGALADRVTQLVG.LE...RDDRRIMLM |
| 167615218/61-392 | VATVVTHLFGGSAGREGTAVQMGGALADRVTQLVG.LE...RDDRRIMLM |
| 254194484/61-392 | VATVVTHLFGGSAGREGTAVQMGGALADRVTQLVG.LD...RDARRIMLM |
| 167907659/61-392 | VATVVTHLFGGSAGREGTAVQMGGALADRVTQLVG.LD...RDARRIMLM |
| 254301074/61-392 | VATVVTHLFGGSAGREGTAVQMGGALADRVTQLVG.LD...RDARRIMLM |
| 167923842/61-392 | VATVVTHLFGGSAGREGTAVQMGGALADRVTQLVG.LD...RDARRIMLM |
| 167577039/61-392 | VATVVTHLFGGSAGREGTAVQMGGALADRVTQLVG.LD...RDDRRIMLM |
| 94990116/66-396 | LSTWVTHLFGASAGREGVAVQIGATISHYCRRFVT.S....QEAARHLLI |
| 83716137/69-400 | VATVVTHLFGGSAGREGTAVQMGGALADRVTQLVG.LE...RDDRRIMLM |
| 94988234/66-396 | FSTWVTHLFGASAGREGVAVQIGATISHYCQRFVT.S....QEAARHLLI |
| 71903194/66-396 | FSTWVTHLFGASAGREGVAVQIGATISHYCQRFVT.S....QEAARHLLI |
| 94992108/66-396 | FSTWVTHLFGASAGREGVAVQIGATISHYCQRFVT.S....QEAARHLLI |
| 306827662/62-392 | FSTWVTHLFGASAGREGVAVQIGATISHYCRRFVT.S....QEAARHLLI |
| 19745820/62-392 | FSTWVTHLFGASAGREGVAVQIGATISHYCRRFVT.S....QEAARHLLI |
| 139474077/62-392 | LSTWVTHLFGASAGREGVAVQIGATISHYCRRFVT.S....QEAARHLLI |
| 71910363/62-392 | FSTWVTHLFGASAGREGVAVQIGATISHYCRRFVT.S....QEAARHLLI |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 50913916/66-396 | FSTWVTHLFGASAGREGVAVQIGATISHYCRRFVT.S....QEAARHLLI |
| 209559106/62-392 | FSTWVTHLFGASAGREGVAVQIGATISHYCRRFVT.S....QEAARHLLI |
| 15674779/62-392 | FSTWVTHLFGASAGREGVAVQIGATISHYCRRFVT.S....QEAARHLLI |
| 167566636/61-392 | AATVVTHLFGGSAGREGTAVQMGGALADRVTQRFR.LD...RDDRRIMLM |
| 167573712/61-392 | AATVVTHLFGGSAGREGTAVQMGGALADRVTQRFR.LD...RDDRRIMLM |
| 251782109/62-392 | FSTWVTHLFGASAGREGVAVQMGATISHYCRRFVT.S....QEAARHLLI |
| 66768521/61-392 | GGTVISHLFGASVGREGTAVQMGAALADQLTRVFR.LL...QQDRRLLLM |
| 21231425/61-392 | GGTVISHLFGASVGREGTAVQMGAALADQLTRVFR.LL...QQDRRLLLM |
| 188991670/81-412 | GGTVISHLFGASVGREGTAVQMGAALADQLTRVFR.LL...QQDRRLLLM |
| 221210981/61-392 | VATVVTHLFGGSAGREGTAVQMGGALADRVTHAFR.LD...REHRRVLLM |
| 189352355/61-392 | VATVVTHLFGGSAGREGTAVQMGGALADRVTHAFR.LD...REHRRVLLM |
| 161521476/61-392 | VATVVTHLFGGSAGREGTAVQMGGALADRVTHAFR.LD...REHRRVLLM |
| 221203824/61-392 | AATVVTHLFGGSAGREGTAVQMGGALADRVTHAFR.LD...REHRRVLLM |
| 221197152/61-392 | AATVVTHLFGGSAGREGTAVQMGGALADRVTHAFR.LD...REHRRVLLM |
| 77408502/58-387 | LTTWLTHLFGGSAGREGVAVQIGATVSHYFQKYCR.L....QNASQLFLV |
| 167583829/60-391 | VATVVTHLFGGSAGREGTAVQMGGALADRVTHALR.LD...REHRRVLLM |
| 77411121/58-387 | LTTWLTHLFGGSAGREGVAVQIGATVSHYFQKYCR.L....QNASQLFLV |
| 76798380/58-387 | LTTWLTHLFGGSAGREGVAVQIGATVSHYFQKYCR.L....QNASQLFLV |
| 76787827/58-387 | LTTWLTHLFGGSAGREGVAVQIGATVSHYFQKYCR.L....QNASQLFLV |
| 25010655/58-387 | LTTWLTHLFGGSAGREGVAVQIGATVSHYFQKYCR.L....QNASQLFLV |
| 22536719/58-387 | LTTWLTHLFGGSAGREGVAVQIGATVSHYFQKYCR.L....QNASQLFLV |
| 170701178/116-447 | VATVVTHLFGGSAGREGTAVQMGGALADRVTHLFR.LD...REHRRVLLM |
| 134292888/61-392 | AATVVTHLFGGSAGREGTAVQMGGALADRVTQLFR.LD...REHRRVLLM |
| 115360262/61-392 | VATVVTHLFGGSAGREGTAVQMGGALADRVTHLFR.LD...REHRRVLLM |
| 172062717/116-447 | VATVVTHLFGGSAGREGTAVQMGGALADRVTHLFR.LD...REHRRVLLM |
| 170736113/61-392 | VATVVTHLFGGSAGREGTAVQMGGALADRITHVLR.LD...REHRRVLLM |
| 254248860/130-461 | VATVVTHLFGGSAGREGTAVQMGGALADRITHVLR.LD...REHRRVLLM |
| 206562684/116-447 | VATVVTHLFGGSAGREGTAVQMGGALADRVTHVFR.LD...REHRRVLLM |
| 116691890/61-392 | VATVVTHLFGGSAGREGTAVQMGGALADRITHVLR.LD...REHRRVLLM |
| 107026913/61-392 | VATVVTHLFGGSAGREGTAVQMGGALADRITHVLR.LD...REHRRVLLM |
| 78063149/61-392 | VATVVTHLFGGSAGREGTAVQMGGALADRITHVFR.LD...REHRRVLLM |
| 224824608/61-392 | GGTVLSHLFGASVGREGTAVQMGGALADQFTHLFK.LR...HEDRRIILM |
| 300697592/50-381 | LGTVVTHLFGGSAGREGTAVQMGGSFADYLTRLFR.LD...QSDRRILLM |
| 187925675/61-392 | IATVVTHLFGGSAGREGTAVQMGGALADQVTKLFG.LE...REDRRILLM |
| 160897178/61-392 | GGTVISHLFGGSAGREGTAVQMGGALADQLTHVFR.LH...QDDRRVLLM |
| 207739311/50-381 | LGTVVTHLFGGSAGREGTAVQMGGSFADYLTRLFH.LD...QGDRRILLM |
| 300311782/61-392 | LGTVASHLFGASVGREGTAVQMGGALADQLTHLLR.LR...PEDRRILLM |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 83748726/62-393 | LGTVVTHLFGGSAGREGTAVQMGGSFADYLTRLFH.LD...QGDRRILLM |
| 17546522/50-381 | LGTVVTHLFGGSAGREGTAVQMGGSFADGLTRLFR.LD...NEARRILLM |
| 207724636/50-381 | LGTVVTHLFGGSAGREGTAVQMGGSFADYLTRLFH.LD...QGDRRILLM |
| 166712100/61-392 | GSTVVSHLFGASVGREGTAVQMGAALADQLTRLLR.LR...NEDRRMVLM |
| 84624054/61-392 | GGTVVSHLFGASVGREGTAVQMGAALADQLTRLLR.LR...NEDRRMVLM |
| 58582162/61-392 | GGTVVSHLFGASVGREGTAVQMGAALADQLTRLLR.LR...NEDRRMVLM |
| 188576912/61-392 | GGTVVSHLFGASVGREGTAVQMGAALADQLTRLLR.LR...NEDRRMVLM |
| 188576721/61-392 | GGTVVSHLFGASVGREGTAVQMGAALADQLTRLLR.LR...NEDRRMVLM |
| 237728386/61-392 | GGTLMSHLFGASVGREGTAVQMGGALADQLTHMFK.VK...KDARRILLM |
| 34497884/61-392 | TGTVVTHLFGGSAGREGTAVQMGGALADQVHKVLP.LQ...PEDRRMLLM |
| 285018239/61-392 | GGTVVSHLFGASVGREGTAVQMGAALADQLTHVLR.MR...RQDRRILLM |
| 66044733/61-398 | IGTVVSHLFGASVGREGTAVQMGGALADQLTHVFR.LR...REDRRVILM |
| 213971827/61-398 | IGTVVSHLFGASVGREGTAVQMGGALADQLTHIFR.LR...REDRRVILM |
| 171058747/61-392 | AGTVISHLFGASVGREGTAVQMGGALADQLTHVFK.LR...PEDRRILLM |
| 238025034/95-426 | LATVVTHLFGGSAGREGTAVQMGGALAERLARLLR.VQ...AETRRILLM |
| 229589423/61-398 | IGTVVSHLFGASVGREGTAVQMGGALADQLTHVFR.LR...REDRRVILM |
| 300693842/50-381 | LGTVVTHLFGGSAGREGTAVQMGGSFADDLTRLFR.LD...KNNRRILLM |
| 28871751/65-402 | IGTVVSHLFGASVGREGTAVQMGGALADQLTHVFR.LR...REDRRVILM |
| 237801960/61-398 | IGTVVSHLFGASVGREGTAVQMGGALADQLTHVFR.LR...REDRRVILM |
| 241665656/62-393 | LSTVVTHIFGGSAGREGTAVQMGGSFADYLTRLFS.LA...PADRRILLM |
| 187926168/62-393 | LSTVVTHIFGGSAGREGTAVQMGGSFADYLTRLFS.LA...PADRRILLM |
| 302059036/73-410 | IGTVVSHLFGASVGREGTAVQMGGALADQLTHIFR.LR...REDRRVILM |
| 309779037/62-393 | LGTVVTHIFGGSAGREGTAVQMGGSFADYLTRLFS.LA...PADRRILLM |
| 126698234/62-390 | SGTWLTHLFGGSAGREGVAVQIGATFSHWVGKRLP.I....KNASSIFLV |
| 306519283/74-402 | SGTWLTHLFGGSAGREGVAVQIGATFSHWVGKRLP.I....KNASSIFLV |
| 260685949/74-402 | SGTWLTHLFGGSAGREGVAVQIGATFSHWVGKRLP.I....KNASSIFLV |
| 260682350/74-402 | SGTWLTHLFGGSAGREGVAVQIGATFSHWVGKRLP.I....KNASSIFLV |
| 255649173/74-402 | SGTWLTHLFGGSAGREGVAVQIGATFSHWVGKRLP.I....KNASSIFLV |
| 255516076/74-402 | SGTWLTHLFGGSAGREGVAVQIGATFSHWVGKRLP.I....KNASSIFLV |
| 255313389/74-402 | SGTWLTHLFGGSAGREGVAVQIGATFSHWVGKRLP.I....KNASSIFLV |
| 255091661/74-402 | SGTWLTHLFGGSAGREGVAVQIGATFSHWVGKRLP.I....KNASSIFLV |
| 254974264/74-402 | SGTWLTHLFGGSAGREGVAVQIGATFSHWVGKRLP.I....KNASSIFLV |
| 225868779/61-391 | LSTWLTHLCGGSAGREGVAVQIGATVSHFFGRLSH.L....KDKSQLFLV |
| 255099763/74-402 | SGTWLTHLFGGSAGREGVAVQIGATFSHWVGKRLP.I....KNASSIFLV |
| 255305648/74-402 | SGTWLTHLFGGSAGREGVAVQIGATFSHWVGKRLP.I....KNASSIFLV |
| 225870265/61-391 | LSTWLTHLCGGSAGREGVAVQIGATVSHFFGRLRH.L....KDKSQLFLV |
| 296878238/74-402 | SGTWLTHLFGGSAGREGVAVQIGATFSHWIGKRLP.I....KNASSIFLV |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 296449441/74-402 | SGTWLTHLFGGSAGREGVAVQIGATFSHWIGKRLP.I....KNASSIFLV |
| 255654699/74-402 | SGTWLTHLFGGSAGREGVAVQIGATFSHWIGKRLP.I....KNASSIFLV |
| 296876619/58-390 | LTTWMSHLFGGSVGREGVAVQIGATLSHRFARYIK.I....PDASRIFLM |
| 163790421/57-388 | IGTWITHLFGGSAGREGVAVQIGATFSHAIGRKIP.F....KNASKIMLI |
| 24379705/63-392 | VTTWLTHLCGGSAGREGVAVQLGATVSHWFSRLFH.F....PNKSRIFLL |
| 290580296/63-392 | VTTWLTHLCGGSAGREGVAVQLGATVSHWFSRLFH.F....PNKSRIFLL |
| 171780017/63-391 | VATWLTHLFGGSAGREGVAVQLGATISHAFSKFFS.F....ENSSRLFLV |
| 261407611/66-398 | IGTLITHLFGGSAGREGTAVQMGGSLSEWLGKLIR.VT...PSDRKILLI |
| 299137255/65-396 | LGTFLTHLFGGSAGREGTALQTGASLADQLTRPLR.LA...PRDRRILLM |
| 237668509/58-389 | LSTWITHLFGGSAGREGVAVQIGATVAHNIGRKID.I....ENSGRIFLI |
| 182416531/58-389 | LSTWITHLFGGSAGREGVAVQIGATVAHNIGRKID.I....ENSGRIFLI |
| 288905673/63-391 | LATWLTHLFGGSAGREGVAVQLGAAIAHGFSRFFD.F....ENNSRLFLV |
| 306831767/63-391 | LATWLTHLFGGSAGREGVAVQLGAAIAHGFSRFFD.F....ENNSRLFLV |
| 125624281/58-389 | FSTWLSHLFGASVGREGVAVQIGGVIGHAIGKKLS.A....KEAKKILLI |
| 306833893/72-400 | LATWLTHLFGGSAGREGVAVQLGAAIAHGFSRFFD.F....ENNSRLFLV |
| 24379706/63-391 | FSTWLTHLFGGSAGREGVAIQVGAALSHAFSPVFK.F....EESSRSFLI |
| 223936158/62-409 | IGTLITHLFGGSAGREGTAVQMGGSLASGFGRLIR.VK...SETMRILLM |
| 168216344/69-400 | FGTIVTHFFGGSAGREGTGVQIGASIAETIGKLLK.LN...KEDSKIMLM |
| 281491597/58-389 | FSTWLSHLFGASVGREGVAVQIGGVIGHAIGKKLS.A....KEAKKILLI |
| 116627914/63-392 | VTTWLTHLFGGSAGREGVAVQLGATVSHAFSRYFK.L....PNASCIFLT |
| 290580295/63-391 | FSTWLTHLFGGSAGREGVAIQVGAALSHAFSPVFK.F....EESSRSFLI |
| 15673080/58-389 | FSTWLSHLFGASVGREGVAVQIGGVIGHAIGKKLS.A....KEAKKILLI |
| 116511937/58-389 | FSTWLSHLFGASVGREGVAVQIGGVIGHAIGKKLS.A....KEAKKILLI |
| 257874163/61-390 | VGTWLTHLFGGSAGREGVAVQLGATIANRLGNWVR.L....EKYASTLIM |
| 257867835/61-390 | VGTWLTHLFGGSAGREGVAVQLGATIANRLGNWVR.L....EKYASTLIM |
| 55821189/63-392 | VTTWLTHLFGGSAGREGVAVQLGATVSHAFSRYFK.L....PNASCIFLT |
| 182626550/69-400 | FGTIVTHFFGGSAGREGTGVQIGASIAETIGKLLK.LN...KEDSKIMLM |
| 110803970/69-400 | FGTVVTHFFGGSAGREGTGVQIGASIAETIGKLLK.LN...KEDSKIMLM |
| 55823099/63-392 | VTTWLTHLFGGSAGREGVAVQLGATVSHAFSRYFK.L....PNASCIFLT |
| 209544766/77-424 | AGTVVSHLFGASVGREGTAVQIGGSIASGFTRLFR.LT...AREVRTLLT |
| 169343074/69-400 | FGTVVTHFFGGSAGREGTGVQIGASIAETIGKLLK.LN...KEDSKIMLM |
| 110800437/69-400 | FGTVVTHFFGGSAGREGTGVQIGASIAETIGKLLK.LN...KEDSKIMLM |
| 168210325/69-400 | FGTVVTHFFGGSAGREGTGVQIGASIAETIGKLLK.LN...KEDSKIMLM |
| 253755995/54-382 | STTWLSHLVGASVGREGVAVQLGASLSHWLQKHGF.T....HLPKDMITK |
| 253754061/54-382 | STTWLSHLVGASVGREGVAVQLGASLSHWLQKHGF.T....HLPKDMITK |
| 253752235/54-382 | STTWLSHLVGASVGREGVAVQLGASLSHWLQKHGF.T....HLPKDMITK |
| 146321395/54-382 | STTWLSHLVGASVGREGVAVQLGASLSHWLQKHGF.T....HLPKDMITK |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 146319191/54-382 | STTWLSHLVGASVGREGVAVQLGASLSHWLQKHGF.T....HLPKDMITK |
| 256423027/87-434 | ATTIITHLFGGSAGREGTAVQIGGSMAHMLGRWFR.LS...AADVKIILM |
| 168207393/69-400 | FGTVVTHFFGGSAGREGTGVQIGASIAETIGKLLK.LN...KEDSKIMLM |
| 168214512/69-400 | FGTIVTHFFGGSAGREGTGVQIGASIAETIGKLLK.LN...KEDSKIMLM |
| 18309572/69-400 | FGTVVTHFFGGSAGREGTGVQIGASIAETIGKLLK.LN...KEDSKIMLM |
| 162149525/77-424 | AGTVVSHLFGASVGREGTAVQIGGSIASGFTRMFR.LT...AREVRTLLT |
| 196229369/63-411 | FGTLVTHLFGGSAGREGTAVQMGGSIASAFCRWYR.LD...ASSVRILLM |
| 257876728/61-390 | VGTWLTHLFGGSVGREGVAVQLGATIANRLGNWLR.L....EKYASTLIM |
| 251797520/69-399 | LGTLLTHLFGGSAGREGTAVQMGGSFSELIGKVFK.VD...ETDRKILLM |
| 195977885/1-309 | LSTWLTHLCGGSAGREGVAVQIGATVSHFFGRLSH.L....KDRSQLFLV |
| 222152807/62-391 | FSTWLTHLFGGSAGREGVAVQIGATLSHYFASYTK.N....KDLSKPFLL |
| 59710638/60-408 | FTTVITHLFGGSAGREGTAVQIGGATTDWLSKVFK.LS...EDDRKMMLT |
| 167766061/56-388 | IGTWLTHLFGGSAGREGVAVQIGATLSHALGRKLN.F....PENGRIMLV |
| 228476400/63-392 | VTTWLTHLFGGSAGREGVAVQLGATVSHAFSRYFK.L....PNASRIFLT |
| 197334244/60-408 | FTTVITHLFGGSAGREGTAVQIGGATTDWLSKVFK.LS...EDDRKMMLT |
| 284005894/64-409 | LTSLLTHLFGGSAGREGTAVQMGGSIAGVLGRQLR.LS...EADLRILLM |
| 95928333/62-409 | FATVITHLFGGSAGREGTAVQMGGSIAQVFSRPFR.LS...EEDTRILLT |
| 307277103/61-391 | FGTITTHLFGGSVGREGTAVQMGGAIANAVGKVFK.LS...ALERQVIII |
| 171911999/62-407 | FGTLVSHLFGGSAGREGTAVQMGGSLASLLSRVCR.LG...PAARRMMLM |
| 257421896/61-391 | FGTITTHLFGGSVGREGTAVQMGGAIANAVGKVFK.LS...ALERQVIII |
| 300779490/57-408 | FATVITHLFGGSAGREGTAVQIGGSIAQMFGKWFR.LN...QRDTGIVLT |
| 257416700/61-391 | FGTITTHLFGGSVGREGTAVQMGGAIANAVGKVFK.LS...ALERQVIII |
| 307271571/61-391 | FGTITTHLFGGSVGREGTAVQMGGAIANAVGKVFK.LS...ALERQVIII |
| 300860446/61-391 | FGTITTHLFGGSVGREGTAVQMGGAIANAVGKVFK.LS...ALERQVIII |
| 257419916/61-391 | FGTITTHLFGGSVGREGTAVQMGGAIANAVGKVFK.LS...ALERQVIII |
| 256963630/61-391 | FGTITTHLFGGSVGREGTAVQMGGAIANAVGKVFK.LS...ALERQVIII |
| 256956740/61-391 | FGTITTHLFGGSVGREGTAVQMGGAIANAVGKVFK.LS...ALERQVIII |
| 255972070/61-391 | FGTITTHLFGGSVGREGTAVQMGGAIANAVGKVFK.LS...ALERQVIII |
| 229549364/61-391 | FGTITTHLFGGSVGREGTAVQMGGAIANAVGKVFK.LS...ALERQVIII |
| 149280114/62-411 | ITTVITHLFGGSAGREGTAVQIGGSIAGMFSRWFK.LN...EVDTKMLLT |
| 307290483/61-391 | FGTITTHLFGGSVGREGTAVQMGGAIANAVGKVFK.LS...ALEREVIII |
| 256853823/61-391 | FGTITTHLFGGSVGREGTAVQMGGAIANAVGKVFK.LS...ALEREVIII |
| 256616980/61-391 | FGTITTHLFGGSVGREGTAVQMGGAIANAVGKVFK.LS...ALERQVIII |
| 229545116/61-391 | FGTITTHLFGGSVGREGTAVQMGGAIANAVGKVFK.LS...ALERQVIII |
| 257081959/61-391 | FGTITTHLFGGSVGREGTAVQMGGAIANAVGKVFK.LS...ALERQVIII |
| 307285753/61-391 | FGTITTHLFGGSVGREGTAVQMGGAIANAVGKVFK.LS...ALERQVIII |
| 255975137/61-391 | FGTITTHLFGGSVGREGTAVQMGGAIANAVGKVFK.LS...ALERQVIII |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 257090652/61-391 | FGTITTHLFGGSVGREGTAVQMGGAIANAVGKVFK.LS...ALERQVIII |
| 256763156/61-391 | FGTITTHLFGGSVGREGTAVQMGGAIANAVGKVFK.LS...ALERQVIII |
| 29376957/61-391 | FGTITTHLFGGSVGREGTAVQMGGAIANAVGKVFK.LS...ALERQVIII |
| 227553996/61-391 | FGTITTHLFGGSVGREGTAVQMGGAIANAVGKVFK.LS...ALERQVIII |
| 307287657/61-391 | FGTITTHLFGGSVGREGTAVQMGGAIANAVGKVFK.LS...ALERQVIII |
| 293387361/61-391 | FGTITTHLFGGSVGREGTAVQMGGAIANAVGKVFK.LS...ALERQVIII |
| 293383526/61-391 | FGTITTHLFGGSVGREGTAVQMGGAIANAVGKVFK.LS...ALERQVIII |
| 256961242/61-391 | FGTITTHLFGGSVGREGTAVQMGGAIANAVGKVFK.LS...ALERQVIII |
| 300731132/63-397 | IGTFMTHLFGGSAGREGTAIQTGASLADQLARPFR.LS...PRDRRILLM |
| 257087493/61-391 | FGTITTHLFGGSVGREGTAVQMGGAIANAVGKVFK.LS...ALEREVIII |
| 307270777/61-391 | FGTITMHLFGGSVGREGTAVQMGGAIANAVGKVFK.LS...ALERQVIII |
| 294780852/61-391 | FGTITMHLFGGSVGREGTAVQMGGAIANAVGKVFK.LS...ALERQVIII |
| 257079694/61-391 | FGTITMHLFGGSVGREGTAVQMGGAIANAVGKVFK.LS...ALERQVIII |
| 222086761/62-408 | VSTVLTHLVGGSAGREGTAVQLGGSIASAFARFFR.LS...HAEVRILLM |
| 257084511/61-391 | FGTITTHLFGGSVGREGTAVQMGGAIANAVGKIFK.LS...ALERQVIII |
| 240137886/73-417 | LGTIVTHLFGGSAGREGTAVQMGGSLASAFGRMFG.VD...AAGVRVLLM |
| 302024216/54-382 | STTWLSHLVGASVGREGVAVQLGASLSHWLKKHGF.T....HLPKDMITK |
| 222147858/69-416 | VSTVLTHLVGGSAGREGTAVQLGGSLASAFAKLFR.LA...QGDVRILLM |
| 293559774/61-391 | FGTITTHLFGGSVGREGTAVQMGGALADNIAHLFR.LD...KAEREILVI |
| 260558935/61-391 | FGTITTHLFGGSVGREGTAVQMGGALADNIAHLFR.LD...KAEREILVI |
| 257890482/61-391 | FGTITTHLFGGSVGREGTAVQMGGALADNIAHLFR.LD...KAEREILVI |
| 154484719/61-393 | IGTWITHLFGGSAGREGVAVQIGATLSHYMGRKLK.T....PDNSRIMLI |
| 227519818/61-391 | FGTITTHLFGGSVGREGTAVQMGGAIANAVGKIFK.LS...ALERQVIII |
| 86143630/67-398 | FGTIATHLFGGSAGREGTAVQIGGAVADQFTKIFK.LN...NQDRKILLI |
| 293568623/61-391 | FGTITTHLFGGSVGREGTAVQMGGALADNIAHLFR.LD...KAEREILVI |
| 251778279/66-397 | IGTFITHLFGGSAGREGTGVQIGSSISEGIGHLFK.LD...KVDTKIILM |
| 257886896/61-391 | FGTITTHLFGGSVGREGTAVQMGGALADNIAHLFR.LD...KAEREILVI |
| 188588504/66-397 | IGTFITHLFGGSAGREGTGVQIGSSISEGISHLFK.LD...KVDTKIILM |
| 293571654/61-391 | FGTITTHLFGGSVGREGTAVQMGGALADNIARLFR.VD...KAEREILII |
| 300863903/61-393 | LGTDITHLFGGSAGREGTALQIAASLADQLTKIFH.FK...HANRRILLM |
| 257895467/61-391 | FGTITTHLFGGSVGREGTAVQMGGALADNIARLFR.LD...KAEREILII |
| 257898081/61-391 | FGTITTHLFGGSVGREGTAVQMGGALADNIAHLFR.LD...KAEREILII |
| 69249390/61-391 | FGTITTHLFGGSVGREGTAVQMGGALADNTARLFR.LD...KSEREILII |
| 258614354/61-391 | FGTITTHLFGGSVGREGTAVQMGGALADNTARLFR.LD...KSEREILII |
| 257893085/61-391 | FGTITTHLFGGSVGREGTAVQMGGALADNTARLFR.LD...KSEREILII |
| 257879974/61-391 | FGTITTHLFGGSVGREGTAVQMGGALADNTARLFR.LD...KSEREILII |
| 294053809/63-411 | LTTVLTHLFGGSAGREGTAVQMGGSTAEYFAQKLG.LG...KEDKRILLM |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 149275805/8-356 | MTTIVTHLFGGSAGREGTAVQIGGSIAGLFGRWFK.LN...EADTKVILT |
| 293553829/61-391 | FGTITTHLFGGSVGREGTAVQMGGALADNTARLFR.LD...KSEREILII |
| 224023708/79-410 | IGTVLTHLFGGSAGREGTGVQMGGAIADQFSRLFH.LH...RRDHKVMVL |
| 294623042/61-391 | FGTITTHLFGGSVGREGTAVQMGGALADNTARLFR.LD...KAEREILII |
| 289567585/61-391 | FGTITTHLFGGSVGREGTAVQMGGALADNTARLFR.LD...KSEREILII |
| 261209457/61-391 | FGTITTHLFGGSVGREGTAVQMGGALADNTARLFR.LD...KSEREILII |
| 257884112/61-391 | FGTITTHLFGGSVGREGTAVQMGGALADNTARLFR.LD...KSEREILII |
| 189460046/67-398 | IGTVLTHLFGGSAGREGTGVQMGGAIADRFSKLFR.LP...RRDHRVMVA |
| 294620207/61-391 | FGTITTHLFGGSVGREGTAVQMGGALADNTARLFR.LD...KSEREILII |
| 118579274/62-407 | VATIISHLFGGSVGREGTAVQMGGSIAAAIGRWFR.LN...LGDFRILLM |
| 58040573/61-408 | IATVVSHLFGASVGREGTAIQVGGSLASATARLFR.LR...APETCVLLT |
| 187932697/74-404 | LGTFVTHLLGGSAGREGTGVQIGSSISEGVGRLLK.LD...KVDTKIILM |
| 293378332/61-391 | FGTITTHLFGGSVGREGTAVQMGGALADNIARLFR.LD...KAEREILII |
| 296115670/62-409 | VATVISHLFGASVGREGTAVQIGGSIASGFGRLFR.LD...HDAVRIVLV |
| 227551941/85-415 | FGTITTHLFGGSVGREGTAVQMGGALADNIARLFR.LD...KAEREILII |
| 294616356/61-391 | FGTITTHLFGGSVGREGTAVQMGGALADNTARLFR.LD...KAEREILII |
| 257883083/61-391 | FGTITTHLFGGSVGREGTAVQMGGSLADNTARLFR.LD...KAEREILII |
| 253771312/60-391 | FGTVVTHLLGGSAGREGTGVQIGASIGENIGKLLK.LN...KYENRIIIM |
| 225166826/60-391 | FGTVVTHLLGGSAGREGTGVQIGASIGENIGKLLK.LN...KYENRIIIM |
| 307688608/69-400 | IGTIITHLFGGSAGREGTAVQIGGSIAEYIGKILK.LD...KTDRRIILM |
| 302873225/69-400 | IGTIITHLFGGSAGREGTAVQIGGSIAEYIGKILK.LD...KTDRRIILM |
| 87306694/62-420 | IGTLITHLFGGSAGREGTAVQMGGSLAGVLGRLLK.LT...PDETRILLS |
| 88801314/65-397 | LGTITHLFGGSAGREGTAVQIGGAIADQFTKI FK.LS...NLDRKILLI |
| 218283679/62-391 | VSTWITHFFGGSAGREGVAMQIGATVSHYFGKYFR.F....KNSGVIFMV |
| 240146274/81-413 | SGTWITHLFGGSAGREGVAVQIGAVLSHVLGRRFH.L....PKDSRVMLI |
| 197301848/54-386 | VGTWLTHLFGGSAGREGVAVQIGAVISHEAGKKFR.C....PENDRIMLV |
| 198275782/67-397 | IGTVLTHLFGGSAGREGTGVQMGGAIADQFSRLFR.MR...RRDHRLMVA |
| 304404790/58-390 | LGTWMTHLLGGSAGREGTAVQIGGSLAEQAGRWFK.LT...PHERRVVLL |
| 227540545/49-380 | LGTIITHLFGGSAGREGTALQMAGAIADQFSKRFR.LN...SEERKILII |
| 260771568/62-409 | VATVVTHLFGGSAGREGTAVQIGGAVSAWFSRVFK.LD...ESDQRSILV |
| 307818395/70-401 | LGTFLTHLFGGSAGREGTALQTGASLADQLTQPLG.LD...GSQRRLLLM |
| 300771325/49-380 | LGTIITHLFGGSAGREGTALQMAGAIADQFSKRFR.LN...AEERKILII |
| 283796370/78-411 | GSTWLTHLFGGSAGREGVAVQIGAAVSHGMFGRLP.F....KNSSRIFLV |
| 300778780/74-405 | LGTIATHFFGGSAGREGTALQMAGAIADQLTKPFK.LD...RNDRKVLII |
| 283856276/78-422 | ISTVITHLFGGSAGREGTAVQLGGSIASGIGRIAG.LD...KKDIRLLLI |
| 260752944/61-405 | ISTVITHLFGGSAGREGTAVQLGGSIASGIGKIAG.LD...KKDIRLLLI |
| 281418863/57-387 | GSTWLTHLFGGSAGREGVATQIGGTLDSYIGNKIR.V....SGANKILMI |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 241761090/61-405 | ISTVITHLFGGSAGREGTAVQLGGSIASGIGKIAG.LD...KKDIRLLLI |
| 255533420/59-389 | TGTVVTHLFGGSAGREGTALQMAAATADQLHKPFK.LN...AAERTILLI |
| 256004137/57-387 | GSTWLTHLFGGSAGREGVATQIGGTLGSYIGNKIR.V....SGANKILMI |
| 251796733/53-386 | FGTIITHLFSGSAGREGTAVQMGGSLAEMIGKRFK.LS...GAERKIILL |
| 125974665/60-390 | GSTWLTHLFGGSAGREGVATQIGGTLGSYIGNKIR.V....SGANKILMI |
| 293374935/63-394 | LGTAVTHLFGGSAGREGTGVQIGASICSKLSHFLH.LN...KEDATILII |
| 149197279/60-400 | LGTIATHLFGGSAGREGTGVQMGGAIADQFSQIFK.LD...KDERRILII |
| 260584530/57-386 | IGTWLAHLFGASVGREGVAVQLGATVANQFQQWFS.S....KRNRQILLM |
| 159897555/58-389 | LGTLLTHLGGGSAGREGTAVQMGASLAARIGRWWR.LP...QAEWRLVVM |
| 108757317/55-387 | VGTVLTHLFGGSAGREGTAVQMGGSLADLVARRFR.VG...PDTRRELLA |
| 310817431/55-387 | LGTVLTHLFGGSAGREGTAVQMGGSLADAIAHRFR.VS...ADTRRELLA |
| 126645925/55-387 | FGTIGTHLFGGSAGREGTAVQMGGSLADQLTKWFK.LS...HEERRLVII |
| 115376569/2-329 | LGTVLTHLFGGSAGREGTAVQMGGSLADAIAHRFR.VS...ADTRRELLA |
| 153853007/62-402 | IGTWTTHLFGGSAGREGVAVQIGAAVSNNIGRLVD.KTIDIENSRKMFLI |
| 189911881/62-391 | FGTLLTHFFGGSAGREGTAVQMGGSIAHQIVRFYR.LS...LKEQQTLII |
| 183221808/62-391 | FGTLLTHFFGGSAGREGTAVQMGGSIAHQIVRFYR.LS...LKEQQTLII |
| 146300126/58-389 | LGTLLTHLFGGSAGREGTAVQMGGAIADQFTKIFN.LD...NAERRILII |
| 283779250/63-421 | LGTLATHVTGGSAGREGTAVQMGGSLAHSVGQWLG.IE...RSEQRTFLM |
| 289639619/53-382 | ICTVLTQLVGGSVGREGTAVQVGGTIANVLGRAFH.LH...HPYHRILVM |
| 296122614/61-407 | LATILTHLGGSAGREGTAVQMGAGLAGIWARWTKPWL...GEDYREILL |
| 241888810/58-377 | LNTLLAHSFGVSVGREGVAVQLGGAIGGNIAPDD..FS...TEKKQFFVK |
| | ........................................... |
| | alignment positions 101-150 |
| 94994029/66-396 | MGMAAGFAGLFQTPIAAVVFALEVLL.VGTL.RYCALL...PSLVAACVA |
| 217422654/69-400 | GGIAAGFSSVFGTPLAGAVFGLEVLA.IGRL.RYDALF...ACVAASIVA |
| 53722888/61-392 | GGIAAGFSSVFGTPLAGAVFGLEVLA.IGRL.RYDALF...ACVAASIVA |
| 167915998/61-392 | GGIAAGFSSVFGTPLAGAVFGLEVLA.IGRL.RYDALF...ACVAASIVA |
| 254208316/69-400 | GGIAAGFSSVFGTPLAGAVFGLEVLA.IGRL.RYDALF...ACVAASIVA |
| 254202983/69-400 | GGIAAGFSSVFGTPLAGAVFGLEVLA.IGRL.RYDALF...ACVAASIVA |
| 254177294/70-401 | GGIAAGFSSVFGTPLAGAVFGLEVLA.IGRL.RYDALF...ACVAASIVA |
| 124381362/70-401 | GGIAAGFSSVFGTPLAGAVFGLEVLA.IGRL.RYDALF...ACVAASIVA |
| 134278691/61-392 | GGIAAGFSSVFGTPLAGAVFGLEVLA.IGRL.RYDALF...ACVAASIVA |
| 53716487/61-392 | GGIAAGFSSVFGTPLAGAVFGLEVLA.IGRL.RYDALF...ACVAASIVA |
| 167002346/61-392 | GGIAAGFSSVFGTPLAGAVFGLEVLA.IGRL.RYDALF...ACVAASIVA |
| 126447166/61-392 | GGIAAGFSSVFGTPLAGAVFGLEVLA.IGRL.RYDALF...ACVAASIVA |
| 121597200/61-392 | GGIAAGFSSVFGTPLAGAVFGLEVLA.IGRL.RYDALF...ACVAASIVA |
| 126442778/69-400 | GGIAAGFSSVFGTPLAGAVFGLEVLA.IGRL.RYDALF...ACVAASIVA |

TABLE 6-continued

Sequences and alignments of examples of fluoride transporters. The first column lists the GI number for the protein in the NCBI RefSeq database and, following the slash, the amino acids positions of the protein that are aligned in the table.

| GI/positions | Sequence |
|---|---|
| 28896294/62-392 | MGMAAGFAGLFQTPIAAVVFALEVLL.VGTL.RYCALL...PSLVAACVA |
| 21910009/62-392 | MGMAAGFAGLFQTPIAAVVFALEVLL.VGTL.RYCALL...PSLVAACVA |
| 242313952/69-400 | GGIAAGFSSVFGTPLAGAVFGLEVLA.IGRL.RYDALF...ACVAASIVA |
| 126458603/69-400 | GGIAAGFSSVFGTPLAGAVFGLEVLA.IGRL.RYDALF...ACVAASIVA |
| 76818704/69-400 | GGIAAGFSSVFGTPLAGAVFGLEVLA.IGRL.RYDALF...ACVAASIVA |
| 254264654/69-400 | GGIAAGFSSVFGTPLAGAVFGLEVLA.IGRL.RYDALF...ACVAASIVA |
| 226195674/69-400 | GGIAAGFSSVFGTPLAGAVFGLEVLA.IGRL.RYDALF...ACVAASIVA |
| 237508459/69-400 | GGIAAGFSSVFGTPLAGAVFGLEVLA.IGRL.RYDALF...ACVAASIVA |
| 167724759/61-392 | GGIAAGFSSVFGTPLAGAVFGLEVLA.IGRL.RYDALF...ACVAASIVA |
| 254186015/61-392 | GGIAAGFSSVFGTPLAGAVFGLEVLA.IGRL.RYDALF...ACVAASIVA |
| 167829250/61-392 | GGIAAGFSSVFGTPLAGAVFGLEVLA.IGRL.RYDALF...ACVAASIVA |
| 254184798/61-392 | GGIAAGFSSVFGTPLAGAVFGLEVLA.IGRL.RYDALF...ACVAASIVA |
| 167850723/61-392 | GGIAAGFSSVFGTPLAGAVFGLEVLA.IGRL.RYDALF...ACVAASIVA |
| 167743705/61-392 | GGIAAGFSSVFGTPLAGAVFGLEVLA.IGRL.RYDALF...ACVAASIVA |
| 257141781/61-392 | GGIAAGFSSVFGTPLAGAVFGLEVLA.IGRL.RYDALL...ACVAASIVA |
| 167615218/61-392 | GGIAAGFSSVFGTPLAGAVFGLEVLA.IGRL.RYDALL...ACVAASIVA |
| 254194484/61-392 | GGIAAGFSSVFGTPLAGAVFGLEVLA.IGRL.RYDALF...ACVAASIVA |
| 167907659/61-392 | GGIAAGFSSVFGTPLAGAVFGLEVLA.IGRL.RYDALF...ACVAASIVA |
| 254301074/61-392 | GGIAAGFSSVFGTPLAGAVFGLEVLA.IGRL.RYDALF...ACVAASIVA |
| 167923842/61-392 | GGIAAGFSSVFGTPLAGAVFGLEVLA.IGRL.RYDALF...ACVAASIVA |
| 167577039/61-392 | GGIAAGFSSVFGTPLAGAVFGLEVLA.IGRL.RYDALL...ACVAASIVA |
| 94990116/66-396 | MGMAAGFAGLFQTPIAAVVFALEVLL.VGTL.RYCALL...PSLVAACVA |
| 83716137/69-400 | GGIAAGFSSVFGTPLAGAVFGLEVLA.IGRL.RYDALL...ACVAASIVA |
| 94988234/66-396 | MGMAAGFAGLFQTPIAAVVFALEVLL.VGTL.RYCALL...PSLVAACVA |
| 71903194/66-396 | MGMAAGFAGLFQTPIAAVVFALEVLL.VGTL.RYCALL...PSLVAACVA |
| 94992108/66-396 | MGMAAGFAGLFQTPIAAVVFALEVLL.VGTL.PYCALL...PSLVAACVA |
| 306827662/62-392 | MGMAAGFAGLFQTPIAAVVFALEVLL.VGTL.RYCALL...PSLVAACVA |
| 19745820/62-392 | MGMAAGFAGLFQTPIAAVVFALEVLL.VGTL.RYCALL...PSLVAACVA |
| 139474077/62-392 | MGMAAGFAGLFQTPIAAVVFALEVLL.VGTL.RYCALL...PSLVAACVA |
| 71910363/62-392 | MGMAAGFAGLFQTPIAAVVFALEVLL.VGTL.RYSALL...PSLVAAYVA |
| 50913916/66-396 | MGMAAGFAGLFQTPIAAVVFALEVLL.VGTL.RYCALL...PSLVAACVA |
| 209559106/62-392 | MGMAAGFAGLFQTPIAAVVFALEVLL.VGTL.RYSALL...PSLVAAYVA |
| 15674779/62-392 | MGMAAGFAGLFQTPIAAVVFALEVLL.VGTL.RYSALL...PSLVAAYVA |
| 167566636/61-392 | SGIAAGFASVFGTPLAGAVFGLEVLA.IGRL.RYDALL...ACVAASIVA |
| 167573712/61-392 | SGIAAGFASVFGTPLAGAVFGLEVLA.IGRL.RYDALL...ACVAASIVA |
| 251782109/62-392 | MGMAAGFAGLFQTPIAAVVFALEVLL.VGTL.RYSALL...PSLVAAYVA |
| 66768521/61-392 | AGISAGFASVFGTPLAGAIFGLEVLV.IGRL.RYDALL...PCTMAAIVA |

TABLE 6-continued

Sequences and alignments of examples of fluoride transporters. The first column lists the GI number for the protein in the NCBI RefSeq database and, following the slash, the amino acids positions of the protein that are aligned in the table.

| GI/positions | Sequence |
|---|---|
| 21231425/61-392 | AGISAGFASVFGTPLAGAIFGLEVLV.IGRL.RYDALL...PCTMAAIVA |
| 188991670/81-412 | AGISAGFASVFGTPLAGAIFGLEVLV.IGRL.RYDALL...PCTMAAIVA |
| 221210981/61-392 | GGIAAGFSSVFGTPLAGAVFGLEVLA.IGRL.RYDALL...ACVASAIVA |
| 189352355/61-392 | GGIAAGFSSVFGTPLAGAVFGLEVLA.IGRL.RYDALL...ACVASAIVA |
| 161521476/61-392 | GGIAAGFSSVFGTPLAGAVFGLEVLA.IGRL.RYDALL...ACVASAIVA |
| 221203824/61-392 | GGIAAGFSSVFGTPLAGAVFGLEVLA.IGRL.RYDALL...ACVASAIVA |
| 221197152/61-392 | GGIAAGFSSVFGTPLAGAVFGLEVLA.IGRL.RYDALL...ACVASAIVA |
| 77408502/58-387 | MGMAAGFAGLFQTPLAATFFAIEVLV.VGRL.MVSYIL...PSLIAALXA |
| 167583829/60-391 | AGIAAGFASVFGTPLAGAVFGLEVLA.IGRV.RYDALL...ACVASAIVA |
| 77411121/58-387 | MGMAAGFAGLFQTPLAATFFAIEVLV.VGRL.MVSYVL...PSLIAALTA |
| 76798380/58-387 | MGMAAGFAGLFQTPLAATFFAIEVLV.VGRL.MVSYVL...PSLIAALTA |
| 76787827/58-387 | MGMAAGFAGLFQTPLAATFFAIEVLV.VGRL.MVSYVL...PSLIAALTA |
| 25010655/58-387 | MGMAAGFAGLFQTPLAATFFAIEVLV.VGRL.MVSYVL...PSLIAALTA |
| 22536719/58-387 | MGMAAGFAGLFQTPLAATFFAIEVLV.VGRL.MVSYVL...PSLIAALTA |
| 170701178/116-447 | GGIAAGFSSVFGTPLAGAVFGLEVLA.IGRL.RYDALL...TCVASAIVA |
| 134292888/61-392 | GGIAAGFSSVFGTPLAGAVFGLEVLA.IGRL.RYDALL...TCVASSIVA |
| 115360262/61-392 | GGIAAGFSSVFGTPLAGAVFGLEVLA.IGRV.RYDALL...TCVASAIVA |
| 172062717/116-447 | GGIAAGFSSVFGTPLAGAVFGLEVLA.IGRV.RYDALL...TCVASAIVA |
| 170736113/61-392 | GGIAAGFASVFGTPLAGAVFGLEVLA.IGRL.RYDALL...TCVASAIVA |
| 254248860/130-461 | GGIAAGFASVFGTPLAGAVFGLEVLA.IGRL.RYDALL...TCVASAIVA |
| 206562684/116-447 | GGIAAGFASVFGTPLAGAVFGLEVLA.IGRV.RYDALL...TCVASAIVA |
| 116691890/61-392 | GGIAAGFASVFGTPLAGAVFGLEVLA.IGRL.RYDALL...TCVASAIVA |
| 107026913/61-392 | GGIAAGFASVFGTPLAGAVFGLEVLA.IGRL.RYDALL...TCVASAIVA |
| 78063149/61-392 | GGIAAGFASVFGTPLAGAVFGLEVLA.IGRV.RYDALL...TCVASAIVA |
| 224824608/61-392 | AGISAGFASVFGTPLAGAIFGLEVLA.IGRL.RYDAIL...PCMVAAIVA |
| 300697592/50-381 | SGISAGFASVFGTPLAGAVFGLEVLA.IGRL.RYDAIL...PCFVAAIVG |
| 187925675/61-392 | GGIAAGFSSVFGTPLAGAIFGLEVLS.IGRL.RYDALL...TCVASSLVA |
| 160897178/61-392 | SGISAGFASVFGTPLAGAVFGLEVLA.IGRM.RYDALF...PCIVAAFVA |
| 207739311/50-381 | SGISAGFASVFGTPLAGAVFGLEVLA.IGRL.RYDAIL...PCFVAAIVG |
| 300311782/61-392 | AGISAGFSSVFGTPMAGAIFGLEVLA.IGRM.RYEAIF...PCFVAAIAA |
| 83748726/62-393 | SGISAGFASVFGTPLAGAVFGLEVLA.IGRL.RYDAIL...PCFVAAIVG |
| 17546522/50-381 | SGISAGFASVFGTPLAGAVFGLEVLA.IGRL.RYDAIL...PCFVAAIVG |
| 207724636/50-381 | SGISAGFASVFGTPLAGAVFGLEVLA.IGRL.RYDAIL...PCFVAAIVG |
| 166712100/61-392 | AGISAGFASVFGTPLAGAIFGLEVLA.IGRL.RYDALL...PCAVAAIVA |
| 84624054/61-392 | AGISAGFASVFGTPLAGAIFGLEVLA.IGRL.RYDALL...PCAVAAIVA |
| 58582162/61-392 | AGISAGFASVFGTPLAGAIFGLEVLA.IGRL.RYDALL...PCAVAAIVA |
| 188576912/61-392 | AGISAGFASVFGTPLAGAIFGLEVLA.IGRL.RYDALL...PCAVAAIVA |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 188576721/61-392 | AGISAGFASVFGTPLAGAIFGLEVLA.IGRL.RYDALL...PCAVAAIVA |
| 237728386/61-392 | AGMSAGFSSVFGTPMAGAIFGMEVLA.IGRI.RYDALF...PCLVAAVLA |
| 34497884/61-392 | AGISVGFASVFGTPLAGAIFGLEMLA.IGRL.RYDAIL...PCLAAAILG |
| 285018239/61-392 | AGISAGFASVFGTPLAGAVFGLEVLA.IGRM.RYDALF...PCILAALIA |
| 66044733/61-398 | AGISAGFASVFGTPLAGALFGLEVLA.IGRM.RYDALF...PCVVAAIVA |
| 213971827/61-398 | AGISAGFASVFGTPLAGALFGLEVLA.IGRM.RYDALF...PCVVAAIVA |
| 171058747/61-392 | AGISAGFASVFGTPLAGAVFGLEVLL.IGRL.RYDALL...PCFTAAIVA |
| 238025034/95-426 | AGIAAGFSSVFGTPLAGAVFGLEVLA.IGRL.RYDALL...PCVAAAIVA |
| 229589423/61-398 | AGISAGFASVFGTPLAGALFGLEVLA.IGRM.RYDALF...PCVVAAIVA |
| 300693842/50-381 | SGISAGFASVFGTPLAGAVFGLEVLA.IGQL.RYDAIL...PCFVAAIVG |
| 28871751/65-402 | AGISAGFASVFGTPLAGALFGLEVLA.IGRM.RYDALF...PCVVAAIVA |
| 237801960/61-398 | AGISAGFASVFGTPLAGALFGLEVLA.IGRM.RYDALF...PCVVAAIVA |
| 241665656/62-393 | AGISAGFASVFGTPLAGAVFGLEVLA.IGRL.RYDAIL...PCFIAAIVG |
| 187926168/62-393 | AGISAGFASVFGTPLAGAVFGLEVLA.IGRL.RYDAIL...PCFIAAIVG |
| 302059036/73-410 | AGISAGFASVFGTPLAGALFGLEVLA.IGRM.RYDALF...PCVVAAIVA |
| 309779037/62-393 | AGISAGFASVFGTPLAGAVFGLEVLA.IGSL.RYDAIL...PCFIAAIMG |
| 126698234/62-390 | TGMAAGFAGLFETPIAAILFAMEVLV.AGSL.EYQSLF...PAFTASFTA |
| 306519283/74-402 | TGIAAGFAGLFETPIAAILFAMEVLV.AGSL.EYQSLF...PAFTASFTA |
| 260685949/74-402 | TGIAAGFAGLFETPIAAILFAMEVLV.AGSL.EYQSLF...PAFTASFTA |
| 260682350/74-402 | TGIAAGFAGLFETPIAAILFAMEVLV.AGSL.EYQSLF...PAFTASFTA |
| 255649173/74-402 | TGIAAGFAGLFETPIAAILFAMEVLV.AGSL.EYQSLF...PAFTASFTA |
| 255516076/74-402 | TGIAAGFAGLFETPIAAILFAMEVLV.AGSL.EYQSLF...PAFTASFTA |
| 255313389/74-402 | TGIAAGFAGLFETPIAAILFAMEVLV.AGSL.EYQSLF...PAFTASFTA |
| 255091661/74-402 | TGIAAGFAGLFETPIAAILFAMEVLV.AGSL.EYQSLF...PAFTASFTA |
| 254974264/74-402 | TGIAAGFAGLFETPIAAILFAMEVLV.AGSL.EYQSLF...PAFTASFTA |
| 225868779/61-391 | MGMAAGFAGLFQTPMTAVVFALEVLL.LGNI.SYLALL...PSLIAAFTA |
| 255099763/74-402 | TGMAAGFAGLFETPIAAILFAMEVLV.AGSL.EYQSLF...PAFTASFTA |
| 255305648/74-402 | TGMAAGFAGLFETPIAAILFAMEVLV.AGSL.EYQSLF...PAFTASFTA |
| 225870265/61-391 | MGMAAGFAGLFQTPMTAVVFALEVLL.LGNI.SYLALL...PSLIAAFTA |
| 296878238/74-402 | TGMAAGFAGLFGTPIAAILFAMEVLV.AGSL.EYQSLF...PAFIASFTA |
| 296449441/74-402 | TGMAAGFAGLFGTPIAAILFAMEVLV.AGSL.EYQSLF...PAFIASFTA |
| 255654699/74-402 | TGMAAGFAGLFGTPIAAILFAMEVLV.AGSL.EYQSLF...PAFIASFTA |
| 296876619/58-390 | TGMAAGFAGLFQTPLAATFFALEVLT.VGEL.QLMALY...PALIASIVA |
| 163790421/57-388 | TGMAAGFGGLFETPFAATFFALEVLV.VGKL.EYLALF...PALIAAFVA |
| 24379705/63-392 | SGMAAGFAGLYQTPMAAILFALEVLV.LGNL.GLSALV...PMTIASFTA |
| 290580296/63-392 | TGMAAGFAGLYQTPMAAILFALEVLV.LGNL.GLSALV...PMTIASFTA |
| 171780017/63-391 | TGMAAGFAGLFQTPLAVFFGLEILV.LGKL.QLPALL...PMTIASFVA |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 261407611/66-398 | CGISGGFGSIFGTPLAGTLFGLEVLA.IGLV.SHQALL...PAFAASMVG |
| 299137255/65-396 | AGISAGFGSVFGTPLAGALFGIEVLA.IGRL.SYEALA...PCMIAAFVG |
| 237668509/58-389 | TGMAAGFAGLFQTPIAAVFFALEVLV.AGTL.EYSALF...TALIGAFSA |
| 182416531/58-389 | TGMAAGFAGLFQTPIAAVFFALEVLV.AGTL.EYSALF...TALIGAFSA |
| 288905673/63-391 | TGMAAGFAGLFQTPIAAVFFALEILV.LGKL.QLQALL...PMTVASFVA |
| 306831767/63-391 | TGMAAGFAGLFQTPIAAVFFALEILV.LGKL.QLQALL...PMTVASFVA |
| 125624281/58-389 | TGMAAGFAGLFQTPIAATFFAIEILM.LGKI.EYRALI...PALVGSYVA |
| 306833893/72-400 | TGMAAGFAGLFQTPIAAVFFALEILV.LGKL.QLQALL...PMTVASFVA |
| 24379706/63-391 | IGIAAGFAGLFQTPMAAILFALEVLV.IGRL.ELSTLL...PTSLAAYTA |
| 223936158/62-409 | SGVAAGFGSVFGTPLTGAVFAMEVLA.VGRI.QYDALV...PTLIASVVG |
| 168216344/69-400 | AGVSGGFSAIFGTPLAGTIFGLEVSV.LGKM.SYEALI...PSFFASIMG |
| 281491597/58-389 | TGMAAGFAGLFQTPIAATFFAIEILM.LGKI.EYRALI...PALVGSYVA |
| 116627914/63-392 | MGMAAGFGGLFQTPIAATFFALEVLT.LGQL.SLPILV...PTLIASFMA |
| 290580295/63-391 | IGIAAGFAGLFQTPMAAILFALEVLV.IGRL.ELSTLL...PTSLAAYTA |
| 15673080/58-389 | TGMAAGFAGLFQTPIAATFFAIEILM.LGKI.EYRALI...PALVGSYVA |
| 116511937/58-389 | TGMAAGFAALFQTPIAATFFAIEILM.LGKI.EYRALI...PALVGSYVA |
| 257874163/61-390 | IGMAAGFAGLFETPIAATFFALEVLV.IGKF.SHHALL...PALLAAFTA |
| 257867835/61-390 | IGMAAGFAGLFETPIAATFFALEVLV.IGKF.SHHALL...PALLAAFTA |
| 55821189/63-392 | MGMAAGFGGLFQTPIAATFFSLEVLT.LGQL.SLPILV...PTLIASFMA |
| 182626550/69-400 | AGVSGGFSAIFGTPLAGTIFGLEVSV.LGKM.SYEALI...PSFFASIVG |
| 110803970/69-400 | AGVSGGFSAIFGTPLAGTIFGLEVSV.LGKM.SYEALI...PSFFASIVG |
| 55823099/63-392 | MGMAAGFGGLFQTPIAATFFALEVLT.LGQL.SLPILV...PTLIASFMA |
| 209544766/77-424 | AGIAAGFGGVFGTPVAGAVFAMEVLS.IGRM.EYSAIV...PVAVAAIAA |
| 169343074/69-400 | AGVSGGFSAIFGTPLAGTIFGLEVSV.LGKM.SYEALI...PSFFASIVG |
| 110800437/69-400 | AGVSGGFSAIFGTPLAGTIFGLEVSV.LGKM.SYEALI...PSFFASIVG |
| 168210325/69-400 | AGVSGGFSAIFGTPLAGTIFGLEVSV.LGKM.SYEALI...PSFFASIVG |
| 253755995/54-382 | IGMAAGFAGLFQTPWAAGFFAIEVLI.VGQY.SWTSLP...YCLVAAFTA |
| 253754061/54-382 | IGMAAGFAGLFQTPWAAGFFAIEVLI.VGQY.SWTSLP...YCLVAAFTA |
| 253752235/54-382 | IGMAAGFAGLFQTPWAAGFFAIEVLI.VGQY.SWTSLP...YCLVAAFTA |
| 146321395/54-382 | IGMAAGFAGLFQTPWAAGFFAIEVLI.VGQY.SWTSLP...YCLVAAFTA |
| 146319191/54-382 | IGMAAGFAGLFQTPWAAGFFAIEVLI.VGQY.SWTSLP...YCLVAAFTA |
| 256423027/87-434 | TGIAAGFGAVFGTPLTGAVFALEVLA.IGLM.RYDALI...PCLIAAVFA |
| 168207393/69-400 | AGVSGGFSAIFGTPLAGTIFGLEVSV.LGKM.SYEALI...PSFFASIVG |
| 168214512/69-400 | AGVSGGFSAIFGTPLAGTIFGLEVSV.LGKM.SYEALI...PSFFASIVG |
| 18309572/69-400 | AGVSGGFSAIFGTPLAGTIFGLEVSV.LGKM.SYEALI...PSFFASIVG |
| 162149525/77-424 | AGIAAGFGGVFGTPVAGAVFAMEVLS.IGRM.EYSAIV...PVAVAAIAA |
| 196229369/63-411 | AGIAAGFGAVFGTPLAGAVFALEVLM.IGRI.EYEALL...PAFIAAVAG |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 257876728/61-390 | IGMAAGFAGLFETPIAATFFALEVLV.IGKF.SHHALL...PALLAAFTA |
| 251797520/69-399 | CGISSGFGSVFGTPLAGTVFGIEVIA.IGFV.RYQAIL...PCFIASFVG |
| 195977885/1-309 | MGMAAGFAGLFQTPMTAVVFALEVLL.LGNI.SYLALL...PSLIAAFTA |
| 222152807/62-391 | IGMSAGFAGLFQTPLAAIVFALEILV.LDSI.KLNALI...PMTLAALTA |
| 59710638/60-408 | AGVAAGFASIFGTPFTGAIFALEVLF.IGRI.KFNAII...PALLAAILA |
| 167766061/56-388 | IGMAAGFGGLFQTPLSATFFAIEVIV.IGKM.DYEALL...PALASAYIA |
| 228476400/63-392 | MGMAAGFGGLFQTPIAATFFALEVLT.LGQL.SLPILV...PTLIASFVA |
| 197334244/60-408 | AGVAAGFASIFGTPFTGAIFALEVLF.IGRI.KFNAII...PALLAAILA |
| 284005894/64-409 | SGIAAGFGAIFGTPLAGAVFALEVLT.IGKL.RYQALI...PCLMASILG |
| 95928333/62-409 | CGVAAGFGAVFGTPLAGAIFALEVLA.VGKM.RYEALI...PCLMASVLG |
| 307277103/61-391 | SGISAGFSSVFGTPLAGTVFGLEVLA.IGKV.RAEALF...PSFFAGLFA |
| 171911999/62-407 | CGVSAGFGSVFGTPLAGAVFAMEVLV.VGRV.QYEALV...PVLVASIVG |
| 257421896/61-391 | SGISAGFSSVFGTPLAGTVFGLEVLA.IGKV.RAEALF...PSFFAGLFA |
| 300779490/57-408 | AGIAAGFGAVFGTPLTGAIFALEVLA.IGKI.KYDALL...PCLIAGTVG |
| 257416700/61-391 | SGISAGFSSVFGTPLAGTVFGLEVLA.IGKV.RAEALF...PSFFAGLFA |
| 307271571/61-391 | SGISAGFSSVFGTPLAGTVFGLEVLA.IGKV.RAEALF...PSFFAGLFA |
| 300860446/61-391 | SGISAGFSSVFGTPLAGTVFGLEVLA.IGKV.RAEALF...PSFFAGLFA |
| 257419916/61-391 | SGISAGFSSVFGTPLAGTVFGLEVLA.IGKV.RAEALF...PSFFAGLFA |
| 256963630/61-391 | SGISAGFSSVFGTPLAGTVFGLEVLA.IGKV.RAEALF...PSFFAGLFA |
| 256956740/61-391 | SGISAGFSSVFGTPLAGTVFGLEVLA.IGKV.RAEALF...PSFFAGLFA |
| 255972070/61-391 | SGISAGFSSVFGTPLAGTVFGLEVLA.IGKV.RAEALF...PSFFAGLFA |
| 229549364/61-391 | SGISAGFSSVFGTPLAGTVFGLEVLA.IGKV.RAEALF...PSFFAGLFA |
| 149280114/62-411 | AGIAAGFGAVFGTPLTGAIFAMEVLA.IGRI.EYKALL...PALIASVLG |
| 307290483/61-391 | SGISAGFSSVFGTPLAGTVFGLEVLA.IGKV.RAEALF...PSFFAGLFA |
| 256853823/61-391 | SGISAGFSSVFGTPLAGTVFGLEVLA.IGKV.RAEALF...PSFFAGLFA |
| 256616980/61-391 | SGISAGFSSVFGTPLAGTVFGLEVLA.IGKV.RAEALF...PSFFAGLFA |
| 229545116/61-391 | SGISAGFSSVFGTPLAGTVFGLEVLA.IGKV.RAEALF...PSFFAGLFA |
| 257081959/61-391 | SGISAGFSSVFGTPLAGTVFGLEVLA.IGKV.RAEALF...PSFFAGLFA |
| 307285753/61-391 | SGISAGFSSVFGTPLAGTVFGLEVLA.IGKV.RAEALF...PSFFAGLFA |
| 255975137/61-391 | SGISAGFSSVFGTPLAGTVFGLEVLA.IGKV.RAEALF...PSFFAGLFA |
| 257090652/61-391 | SGISAGFSSVFGTPLAGTVFGLEVLA.IGKV.RAEALF...PSFFAGLFA |
| 256763156/61-391 | SGISAGFSSVFGTPLAGTVFGLEVLA.IGKV.RAEALF...PSFFAGLFA |
| 29376957/61-391 | SGISAGFSSVFGTPLAGTVFGLEVLA.VGKV.RAEALF...PSFFAGLFA |
| 227553996/61-391 | SGISAGFSSVFGTPLAGTVFGLEVLA.VGKV.RAEALF...PSFFAGLFA |
| 307287657/61-391 | SGISAGFSSVFGTPLAGTVFGLEVLA.IGKV.RAEALF...PSFFAGLFA |
| 293387361/61-391 | SGISAGFSSVFGTPLAGTVFGLEVLA.IGKV.RAEALF...PSFFAGLFA |
| 293383526/61-391 | SGISAGFSSVFGTPLAGTVFGLEVLA.IGKV.RAEALF...PSFFAGLFA |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 256961242/61-391 | SGISAGFSSVFGTPLAGTVFGLEVLA.IGKV.RAEALF...PSFFAGLFA |
| 300731132/63-397 | AGISAGFASVFGTPLAGAIFGLEVLA.IGTL.SYEAIA...PCFMAAFVG |
| 257087493/61-391 | SGISAGFSSVFGTPLAGTVFGLEVLA.IGKV.RAEALF...PSFFAGLFA |
| 307270777/61-391 | SGISAGFSSVFGTPLAGTVFGLEVLA.IGKV.RAEALF...PSFFAGLFG |
| 294780852/61-391 | SGISAGFSSVFGTPLAGTVFGLEVLA.IGKV.RAEALF...PSFFAGLFA |
| 257079694/61-391 | SGISAGFSSVFGTPLAGTVFGLEVLA.IGKV.RAEALF...PSFFAGLFA |
| 222086761/62-408 | AGIAAGFGAVFGTPIAGAVFALEVLT.IGRM.QYEALI...PSLVAAIAA |
| 257084511/61-391 | SGISAGFSSVFGTPLAGTVFGLEVLA.IGKV.RAEALF...PSFFAGLFA |
| 240137886/73-417 | AGIAAGFGAVFGTPIAGAVFALEVLA.VGRV.EYAALV...PCLLAAVVG |
| 302024216/54-382 | IGMAAGFAGLFQTPLAAIFFAIEVLI.VGQY.SWTSLP...YCLVAAFTA |
| 222147858/69-416 | AGIAAGFGAVFGTPIAGAVFALEVLT.IGRM.QYEALL...PALLAAVVA |
| 293559774/61-391 | SGISAGFSSVFGTPLAGTLFGLEVLA.IGKV.RTEAIF...PSFFAALFA |
| 260558935/61-391 | SGISAGFSSVFGTPLAGTLFGLEVLA.IGKV.RTEAIF...PSFFAALFA |
| 257890482/61-391 | SGISAGFSSVFGTPLAGTLFGLEVLA.IGKV.RTEAIF...PSFFAALFA |
| 154484719/61-393 | TGMAAGFGGLFQTPLAATFFAMEVIV.AGYM.DYQALL...PAITAAFVA |
| 227519818/61-391 | SGISAGFSSVFGTPLAGTVFGLEVLA.IGKV.RAEALF...PSFFAGLFA |
| 86143630/67-398 | AGISAGFASVFGTPLAGGIFALEVLI.LGRI.RLDAIV...PSFLAAVLA |
| 293568623/61-391 | SGISAGFSSVFGTPLAGTLFGLEVLA.IGKV.RTEAIF...PSFFAALFA |
| 251778279/66-397 | CGISSGFSSVFGTPLAGTMFGLEVAA.LGTM.SYQALI...PCFTSAFVG |
| 257886896/61-391 | SGISAGFSSVFGTPLAGTLFGLEVLA.IGKV.RTEAIF...PSFFAALFA |
| 188588504/66-397 | CGISSGFSSVFGTPLAGTMFGLEVAA.LGTM.SYQALI...PCFTSAFVG |
| 293571654/61-391 | SGISAGFSSVFGTPLAGTLFGLEVLT.IGKV.RTEAIF...PSFFAALFA |
| 300863903/61-393 | SALSGGFASVFGTPLAGTIFGLEVLA.IGTI.QHDALF...PCLVAAVVG |
| 257895467/61-391 | SGISAGFSSVFGTPLAGTLFGLEVLA.IGKV.RTEAIF...PSFFAALFA |
| 257898081/61-391 | SGISAGFSSVFGTPLAGTLFGLEVLT.IGKV.RTEAIF...PSFFAALFA |
| 69249390/61-391 | SGISAGFSSVFGTPLAGTLFGLEVLA.IGKV.RTEAIF...PSFFAALFA |
| 258614354/61-391 | SGISAGFSSVFGTPLAGTLFGLEVLA.IGKV.RTEAIF...PSFFAALFA |
| 257893085/61-391 | SGISAGFSSVFGTPLAGTLFGLEVLA.IGKV.RTEAIF...PSFFAALFA |
| 257879974/61-391 | SGISAGFSSVFGTPLAGTLFGLEVLA.IGKV.RTEAIF...PSFFAALFA |
| 294053809/63-411 | AGMAAGFGAVFGTPVTGAIFALEVLA.VGRI.KYDALL...PCLFASLIA |
| 149275805/8-356 | AGIAAGFGAVFGTPLTGAIFAIEVLT.IGRM.KYDALL...PALIASFIG |
| 293553829/61-391 | SGISAGFSSVFGTPLAGTLFGLEVLA.IGKV.RTEAIF...PSFFAALFA |
| 224023708/79-410 | IGISAGFASVFGTPLAGAVFGLEVIV.VGRM.RYEAIL...PAFLSAAFA |
| 294623042/61-391 | SGISAGFSSVFGTPLAGTLFGLEVLA.IGKV.RTEAIF...PSFFAALFA |
| 289567585/61-391 | SGISAGFSSVFGTPLAGTLFGLEVLA.IGKV.RTEAIF...PSFFAALFA |
| 261209457/61-391 | SGISAGFSSVFGTPLAGTLFGLEVLA.IGKV.RTEAIF...PSFFAALFA |
| 257884112/61-391 | SGISAGFSSVFGTPLAGTLFGLEVLA.IGKV.RTEAIF...PSFFAALFA |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 189460046/67-398 | IGISAGFASIFGTPLAGAVFGLEVII.VGRM.RYESIL...PVFLSAAFA |
| 294620207/61-391 | SGISAGFSSVFGTPLAGTLFGLEVLA.IGKV.RTEAIF...PSFFAALFA |
| 118579274/62-407 | AGIAAGFGAVFGTPLTGAVFAMEVLA.VGRM.NYDALI...PCLAAAIIG |
| 58040573/61-408 | CGIAAGFGAVFGTPIAGAVFALEVLT.LGRL.DYRFLL...PAAMSSIIA |
| 187932697/74-404 | CGISSGFSSVFGTPLAGTIFGLEVAT.LGTM.SYQALI...PCFTSAFIG |
| 293378332/61-391 | SGISAGFSSVFGTPLAGTLFGLEVLA.IGKV.RTEAIF...PSFFAALFA |
| 296115670/62-409 | SGVAAGFGAVFGTPIAGAIFALEVLS.IGQI.NYRPLL...PAAFSSILA |
| 227551941/85-415 | SGISAGFSSVFGTPLAGTLFGLEVLA.IGKV.RTEAIF...PSFFAALFA |
| 294616356/61-391 | SGISAGFSSVFGTPLAGTLFGLEVLA.IGKV.RTEAIF...PSFFAALFA |
| 257883083/61-391 | SGISAGFSSVFGTPLAGTLFGLEVLA.IGKV.RTEAIF...PSFFAALFA |
| 253771312/60-391 | AGVSGGFSAIFGTPLAGTIFGLEVSV.IGKM.SYEALI...PCLAASILG |
| 225166826/60-391 | AGVSGGFSAIFGTPLAGTIFGLEVSV.IGKM.SYEALI...PCLAASILG |
| 307688608/69-400 | CGISSGFGSVFGTPLAGTIFGMEVIA.IGTM.EYSALI...PCFIASFVG |
| 302873225/69-400 | CGISSGFGSVFGTPLAGTIFGMEVIA.IGTM.EYSALI...PCFIASFVG |
| 87306694/62-420 | AGVAAGFGAVFGTPLTGAIFAVEVIA.IGKM.SYKALI...PCLLASVIG |
| 88801314/65-397 | AGISAGFSAVFGTPLAGAIFALEVLL.IGRV.KYDALL...PSFLAAIFA |
| 218283679/62-391 | AGMAAGFAGLFGTPITAIFFALEVLV.AGTL.KYRAMS...CAIPASFTA |
| 240146274/81-413 | TGMAAGFGGLFQTPLTAVFFSMEVIV.AGKI.QYEALL...PALIASYTA |
| 197301848/54-386 | AGMAAGFGGLFQTPLAAVFFAMEVIA.SGYM.QYEALL...PAMISAYTA |
| 198275782/67-397 | IGISAGFASVFGTPLAGAVFGLEVIV.VGRM.RYEAIL...PSFLSAAVA |
| 304404790/58-390 | CGISSGFGSVFGTPLAGAIFGVELLA.KGRLWRFAALL...PCLLSSLAA |
| 227540545/49-380 | AAVAAGFGSVFGTPLAGAIFGMEFFL.IGRL.RYNAIF...PAFASAICA |
| 260771568/62-409 | AGIAAGFGSVFGTPIAGAIFAVEVLS.VGRI.KYQALL...PALIAAVLA |
| 307818395/70-401 | AGLSAGFGSVFGTPLAGFVFGMEVLG.VARL.LTPALG...PCLIAVVVG |
| 300771325/49-380 | AAVAAGFGSVFGTPLAGAIFGMEFFL.IGRL.RYNAIF...PAFASAICA |
| 283796370/78-411 | TGMAAGFAGLFRTPLAAVLFAAEVLW.AGRL.ECRALV...PALTASFTA |
| 300778780/74-405 | SAIAAGFGSVFGTPLAGAVFGLEVFL.IGRI.RYNAIF...PAFASAVLA |
| 283856276/78-422 | SGIAAGFGAVFGTPVTGAIFALEVPV.IGRL.EYRALI...PALTAAILG |
| 260752944/61-405 | SGIAAGFGAVFGTPVTGAIFALEVPV.IGRL.EYRALI...PALTAAILG |
| 281418863/57-387 | SGMAAGFSGLFHTPLAAVFFALEVLH.CGVI.EYSALL...PSFVSAYTA |
| 241761090/61-405 | SGIAAGFGAVFGTPVTGAIFALEVPV.IGRL.EYRALI...PALTAAILG |
| 255533420/59-389 | AGLSAGFASVFGTPLAGIVFGVEVLL.LGKI.PVKAIL...PAIVTAFIG |
| 256004137/57-387 | SGMAAGFSGLFHTPLAAVFFALEVLH.CGVI.EYSALL...PSFVSAYTA |
| 251796733/53-386 | CGISSGFGSVFGTPAAGAIFALEVAA.LGAI.SLESIL...PIFLASYAG |
| 125974665/60-390 | SGMAAGFSGLFHTPLAAVFFALEVLH.CGVI.EYSALL...PSFVSAYTA |
| 293374935/63-394 | SGVSSGFGVVFGTPIAGTIFGLEVST.IGKM.RYESII...PCLLSSYIG |
| 149197279/60-400 | AGVAAGFSAVFGTPLAGAVFALEVYI.IGRV.QYQAIL...PAFLSAIIA |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 260584530/57-386 | IGMASGFAGLFGTPLAATFFAIEVMI.VGQL.QIDALF...YALLSSFIS |
| 159897555/58-389 | MGISAGFSSVFGTPIAGTIFAMEVLA.FGVL.RYEALL...PCLVAALVG |
| 108757317/55-387 | AGIAGGFGSVFGTPVAGAVFGLEVVV.VGRM.GYEALL...PALVASVVG |
| 310817431/55-387 | AGIAGGFGSVFGTPIAGAVFGLEVLV.VGRL.GYEALL...PALVAAVVG |
| 126645925/55-387 | AGVAAGFASVFGTPLAGAIFALEWML.SRKF.RWRSLY...PAFFTGYIA |
| 115376569/2-329 | AGIAGGFGSVFGTPIAGAVFGLEVLV.VGRL.GYEALL...PALVAAVVG |
| 153853007/62-402 | TGMAAGFSGLFCTPLAAIFFALEVLV.AGKL.EYHALI...PATVASISA |
| 189911881/62-391 | LGMSAGFSAVFGTPIAAAIFSIEVIQ.IGAY.RWKLFL...PSLLIAWIS |
| 183221808/62-391 | LGMSAGFSAVFGTPIAAAIFSIEVIQ.IGAY.RWKLFL...PSLLIAWIS |
| 146300126/58-389 | LGISAGFASVFGTPLAGAVFALEVLY.FSKI.NFKSAL...LSFVVAYAA |
| 283779250/63-421 | AGMAAGFGAVFGTPVAGAIFAIEVLT.HGQL.SYRGFL...TCLLASIVG |
| 289639619/53-382 | AGISAGFGSVFGMPLAGAVFGMEMCF.VGHL.GYEALL...PCFVASFTA |
| 296122614/61-407 | MGVAAGFGGVFGTPVAGAIFAAEVLS.VGRL.PTSAIL...PCLLASCGA |
| 241888810/58-377 | LGMICGFAGLFQTPLAAVVFILEVVSDKFNF.TINKIFEYVTYIAAAYIS |
| | ................................................ |
| | alignment positions 151-200 |
| 94994029/66-396 | SWTS.HSLG....L.EKFTIV.LEET...........LTI.T.P.L.TL |
| 217422654/69-400 | DAVC.RLWG....V.HHTVYV.VPFV...........PAP.S.A.A.GV |
| 53722888/61-392 | DAVC.RLWG....V.HHTVYV.VPFV...........PAP.S.A.A.GV |
| 167915998/61-392 | DAVC.RLWG....V.HHTVYV.VPFV...........PAP.S.A.A.GV |
| 254208316/69-400 | DAVC.RLWG....V.HHTVYV.VPFV...........PAP.S.A.A.GV |
| 254202983/69-400 | DAVC.RLWG....V.HHTVYV.VPFV...........PAP.S.A.A.GV |
| 254177294/70-401 | DAVC.RLWG....V.HHTVYV.VPFV...........PAP.S.A.A.GV |
| 124381362/70-401 | DAVC.RLWG....V.HHTVYV.VPFV...........PAP.S.A.A.GV |
| 134278691/61-392 | DAVC.RLWG....V.HHTVYV.VPFV...........PAP.S.A.A.GV |
| 53716487/61-392 | DAVC.RLWG....V.HHTVYV.VPFV...........PAP.S.A.A.GV |
| 167002346/61-392 | DAVC.RLWG....V.HHTVYV.VPFV...........PAP.S.A.A.GV |
| 126447166/61-392 | DAVC.RLWG....V.HHTVYV.VPFV...........PAP.S.A.A.GV |
| 121597200/61-392 | DAVC.RLWG....V.HHTVYV.VPFV...........PAP.S.A.A.GV |
| 126442778/69-400 | DAVC.RLWG....V.HHTVYV.VPFV...........PAP.S.A.A.GV |
| 28896294/62-392 | SWTS.HSLG....L.EKFTIV.LEET...........LTI.T.P.L.TL |
| 21910009/62-392 | SWTS.HSLG....L.EKFTIV.LEET...........LTI.T.P.L.TL |
| 242313952/69-400 | DAVC.RLWG....V.HHTVYV.VPFV...........PAP.S.A.A.GV |
| 126458603/69-400 | DAVC.RLWG....V.HHTVYV.VPFV...........PAP.S.A.A.GV |
| 76818704/69-400 | DAVC.RLWG....V.HHTVYV.VPFV...........PAP.S.A.A.GV |
| 254264654/69-400 | DAVC.RLWG....V.HHTVYV.VPFV...........PAP.S.A.A.GV |
| 226195674/69-400 | DAVC.RLWG....V.HHTVYV.VPFV...........PAP.S.A.A.GV |
| 237508459/69-400 | DAVC.RLWG....V.HHTVYV.VPFV...........PAP.S.A.A.GV |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 167724759/61-392 | DAVC.RLWG....V.HHTVYV.VPFV............PAP.S.A.A.GV |
| 254186015/61-392 | DAVC.RLWG....V.HHTVYV.VPFV............PAP.S.A.A.GV |
| 167829250/61-392 | DAVC.RLWG....V.HHTVYV.VPFV............PAP.S.A.A.GV |
| 254184798/61-392 | DAVC.RLWG....V.HHTVYV.VPFV............PAP.S.A.A.GV |
| 167850723/61-392 | DAVC.RLWG....V.HHTVYV.VPFV............PAP.S.A.A.GV |
| 167743705/61-392 | DAVC.RLWG....V.HHTVYV.VPFV............PAP.S.A.A.GV |
| 257141781/61-392 | DAVC.RLWG....I.HHTVYV.VPFV............PAL.S.A.A.GV |
| 167615218/61-392 | DAVC.RLWG....I.HHTVYV.VPFV............PAL.S.A.A.GV |
| 254194484/61-392 | DAVC.RLWG....V.HHTVYV.VPFV............PAP.S.A.A.GV |
| 167907659/61-392 | DAVC.RLWG....V.HHTVYV.VPFV............PAP.S.A.A.GV |
| 254301074/61-392 | DAVC.RLWG....V.HHTVYV.VPFV............PAP.S.A.A.GV |
| 167923842/61-392 | DAVC.RLWG....V.HHTVYV.VPFV............PAP.S.A.A.GV |
| 167577039/61-392 | DAVC.RLWG....I.HHTVYV.VPFV............PAL.S.A.A.GV |
| 94990116/66-396 | SWTS.HSLG....L.EKFTIV.LEET............LTI.T.P.L.TL |
| 83716137/69-400 | DAVC.RLWG....I.HHTVYV.VPFV............PAL.S.A.A.GV |
| 94988234/66-396 | SWTS.HSLG....L.EKFTIV.LEET............LTI.T.P.L.TL |
| 71903194/66-396 | SWTS.HSLG....L.EKFTIV.LEET............LTI.T.P.L.TL |
| 94992108/66-396 | SWTS.HSLG....L.EKFTIV.LEET............LTI.T.P.L.TL |
| 306827662/62-392 | SWTS.HSLG....L.EKFTIV.LEET............LTI.T.P.L.TL |
| 19745820/62-392 | SWTS.HSLG....L.EKFTIV.LEET............LTI.T.P.L.TL |
| 139474077/62-392 | SWTS.HSLG....L.EKFTIV.LEET............LTI.T.P.L.TL |
| 71910363/62-392 | SWTS.HALG....L.EKFTIV.LEET............LTI.T.P.L.TL |
| 50913916/66-396 | SWTS.HSLG....L.EKFTIV.LEET............LTI.T.P.L.TL |
| 209559106/62-392 | SWTS.HALG....L.EKFTIV.LEET............LTI.T.P.L.TL |
| 15674779/62-392 | SWTS.HALG....L.EKFTIV.LEET............LTI.T.P.L.TL |
| 167566636/61-392 | DAVC.RLWG....I.HHTVYA.VPFV............PAL.S.A.A.GV |
| 167573712/61-392 | DAVC.RLWG....I.HHTVYA.VPFV............PAL.S.A.A.GV |
| 251782109/62-392 | SWTS.HALG....L.EKFTIV.LEET............LTI.T.P.L.TL |
| 66768521/61-392 | NQVC.LAWG....I.QHTHYA.IERI............VPV.G.V.G.SV |
| 21231425/61-392 | NQVC.LAWG....I.QHTHYA.IERI............VPV.G.V.G.SV |
| 188991670/81-412 | NQVC.LAWG....I.QHTHYA.IERI............VPV.G.V.G.SV |
| 221210981/61-392 | DVVC.RAWG....V.HHTVYA.VPFV............PAV.S.A.A.GL |
| 189352355/61-392 | DVVC.RAWG....V.HHTVYA.VPFV............PAV.S.A.A.GL |
| 161521476/61-392 | DVVC.RAWG....V.HHTVYA.VPFV............PAV.S.A.A.GL |
| 221203824/61-392 | DVVC.RAWG....V.HHTVYA.VPFV............PAV.S.A.A.GL |
| 221197152/61-392 | DVVC.RAWG....V.HHTVYA.VPFV............PAV.S.A.A.GL |
| 77408502/58-387 | NFVS.HSLG....L.EKFSHS.IATS............MAL.T.P.D.II |

TABLE 6-continued

Sequences and alignments of examples of fluoride transporters. The first column lists the GI number for the protein in the NCBI RefSeq database and, following the slash, the amino acids positions of the protein that are aligned in the table.

| | | | |
|---|---|---|---|
| 167583829/60-391 | DVVC.RLWG....V.HHTAYA.IPFV | ............PPV.S.A.A.GL |
| 77411121/58-387 | NFVS.HSLG....L.EKFSHS.IATS | ............MAL.T.P.D.II |
| 76798380/58-387 | NFVS.HSLG....L.EKFSHS.IATS | ............MAL.T.P.D.II |
| 76787827/58-387 | NFVS.HSLG....L.EKFSHS.IATS | ............MAL.T.P.D.II |
| 25010655/58-387 | NFVS.HSLG....L.EKFSHS.IATS | ............MAL.T.P.D.II |
| 22536719/58-387 | NFVS.HSLG....L.EKFSHS.IATS | ............MAL.T.P.D.II |
| 170701178/116-447 | DVVC.RAWG....V.HHTAYA.IPFV | ............PAV.S.A.T.GL |
| 134292888/61-392 | DVVC.RAWG....V.HHTVYA.IASV | ............PAV.S.A.T.GL |
| 115360262/61-392 | DVVC.RAWG....V.HHTVYA.IPFV | ............PAV.S.A.T.GL |
| 172062717/116-447 | DVVC.RAWG....V.HHTVYA.IPFV | ............PAV.S.A.T.GL |
| 170736113/61-392 | DVVC.RAWG....V.HHTAYA.IPFV | ............PAV.S.A.T.GL |
| 254248860/130-461 | DVVC.RAWG....V.HHTAYA.IPFV | ............PAV.S.A.T.GL |
| 206562684/116-447 | DVVC.RAWG....V.HHTAYA.IPFV | ............PAV.S.A.T.GL |
| 116691890/61-392 | DVVC.RAWG....V.HHTAYA.IPFV | ............PAV.S.A.T.GL |
| 107026913/61-392 | DVVC.RAWG....V.HHTAYA.IPFV | ............PAV.S.A.T.GL |
| 78063149/61-392 | DVVC.RAWG....V.HHTAYA.IPFV | ............PAV.S.A.T.GL |
| 224824608/61-392 | DQVG.LLWG....V.HHTRYV.IPFI | ............PPL.S.A.W.GL |
| 300697592/50-381 | DLVP.PLLG....V.HHTPYV.IPFV | ............PHL.T.P.L.AI |
| 187925675/61-392 | NQVC.RVWG....I.HHTVYT.IPFV | ............PHV.S.P.L.GL |
| 160897178/61-392 | DQVC.TAWG....V.HHTHYA.MSAV | ............NNI.D.A.W.SV |
| 207739311/50-381 | DLVP.PLLG....V.HHTPYV.IPFV | ............PHL.T.P.L.AI |
| 300311782/61-392 | DQVG.LAWG....V.HHTHYA.MNAS | ............APM.A.L.W.SV |
| 83748726/62-393 | DLVP.PLLG....V.HHTPYV.IPFV | ............PHL.T.P.L.AI |
| 17546522/50-381 | DLVP.PLLG....V.HHTPYA.IPFV | ............PHL.T.P.L.AI |
| 207724636/50-381 | DLVP.PLLG....V.HHTPYV.IPFV | ............PHL.T.P.L.AI |
| 166712100/61-392 | DQVC.LAWG....I.HHIHDP.IGQI | ............VPV.G.I.G.SV |
| 84624054/61-392 | DQVC.LAWG....I.HHIHYP.IGQI | ............VPV.G.I.G.SV |
| 58582162/61-392 | DQVC.LAWG....I.HHIHYP.IGQI | ............VPV.G.I.G.SV |
| 188576912/61-392 | DQVC.LAWG....I.HHIHYP.IGQI | ............VPV.G.I.G.SV |
| 188576721/61-392 | DQVC.LAWG....I.HHIHYP.IGQI | ............VPV.G.I.G.SV |
| 237728386/61-392 | DQVC.LAWG....V.HHTHYR.IDFI | ............PAF.T.I.W.SF |
| 34497884/61-392 | DQAS.LLWG....V.HHTFYR.IPFI | ............PAL.D.A.W.GL |
| 285018239/61-392 | DQTC.LAWG....V.HHTPYA.IGQS | ............VPV.S.V.G.SV |
| 66044733/61-398 | DQVG.QAWG....V.VHTHYV.IGEV | ............VPV.Q.L.W.SV |
| 213971827/61-398 | DQVG.QAWG....V.VHTHYV.IGEV | ............VPV.Q.L.W.SV |
| 171058747/61-392 | DQVT.TAWG....V.HHTHYL.AGLI | ............PAV.S.A.W.TL |
| 238025034/95-426 | DAVC.RWWG....I.HHPLYP.VPFV | ............PAL.S.L.A.TA |

TABLE 6-continued

Sequences and alignments of examples of fluoride transporters. The first column lists the GI number for the protein in the NCBI RefSeq database and, following the slash, the amino acids positions of the protein that are aligned in the table.

| | | |
|---|---|---|
| 229589423/61-398 | DQVG.KAWG....V.VHTHYV.IGEV | ...........VPV.Q.L.W.SV |
| 300693842/50-381 | DLVP.PLLG....V.HHTPYA.IPFV | ...........PHL.T.P.L.AI |
| 28871751/65-402 | DQVG.QAWG....V.VHTHYV.IGEV | ...........VPV.Q.L.W.SV |
| 237801960/61-398 | DQVG.QAWG....V.VHTHYV.IGEV | ...........VPV.Q.L.W.SV |
| 241665656/62-393 | DLVP.PLLG....V.HHTPYA.IPFV | ...........PHL.T.P.V.AI |
| 187926168/62-393 | DLVP.PLLG....V.HHTPYA.IPFV | ...........PHL.T.P.V.AI |
| 302059036/73-410 | DQVG.QAWG....V.VHTHYV.IGEV | ...........VPV.Q.L.W.SV |
| 309779037/62-393 | DLVP.PLLG....V.HHTPYA.IPFV | ...........PHL.T.P.I.AI |
| 126698234/62-390 | SAVS.KALG....L.EKFSFA.LSSK | ...........VVF.D.L.S.IF |
| 306519283/74-402 | SAVS.KTLG....L.EKFSFA.LSSK | ...........VVF.D.L.P.IF |
| 260685949/74-402 | SAVS.KTLG....L.EKFSFA.LSSK | ...........VVF.D.L.P.IF |
| 260682350/74-402 | SAVS.KTLG....L.EKFSFA.LSSK | ...........VVF.D.L.P.IF |
| 255649173/74-402 | SAVS.KTLG....L.EKFSFA.LSSK | ...........VVF.D.L.P.IF |
| 255516076/74-402 | SAVS.KTLG....L.EKFSFA.LSSK | ...........VVF.D.L.P.IF |
| 255313389/74-402 | SAVS.KTLG....L.EKFSFA.LSSK | ...........VVF.D.L.P.IF |
| 255091661/74-402 | SAVS.KTLG....L.EKFSFA.LSSK | ...........VVF.D.L.P.IF |
| 254974264/74-402 | SAVS.KTLG....L.EKFSFA.LSSK | ...........VVF.D.L.P.IF |
| 225868779/61-391 | SWTS.HCLG....L.EKFSVP.IAKA | ...........LKI.T.P.I.TF |
| 255099763/74-402 | SAVS.KALG....L.EKFSFA.LSSE | ...........VVF.D.L.S.IF |
| 255305648/74-402 | SSVS.KALG....L.EKFSFA.LSSK | ...........VVF.D.L.S.IF |
| 225870265/61-391 | SWTS.HCLG....L.EKFSVP.IAKA | ...........LKI.T.P.I.TF |
| 296878238/74-402 | SEVT.KALG....L.EKFSFA.LSSK | ...........VVF.D.L.S.IF |
| 296449441/74-402 | SEVT.KALG....L.EKFSFA.LSSK | ...........VVF.D.L.S.IF |
| 255654699/74-402 | SEVT.KALG....L.EKFSFA.LSSK | ...........VVF.D.L.S.IF |
| 296876619/58-390 | SFTS.HALG....L.EKFAVP.LRET | ...........LSW.T.P.E.TL |
| 163790421/57-388 | SYVS.HFLG....L.EKFSVN.LDVA | ...........VTM.D.S.Q.TI |
| 24379705/63-392 | SLTS.HSLG....L.EKFAHT.LSRT | ...........ISL.T.P.T.VF |
| 290580296/63-392 | SLTS.HSLG....L.EKFAHT.LSRT | ...........ISL.T.P.T.VF |
| 171780017/63-391 | SATS.HALG....L.EKFAHF.VNVS | ...........LTF.N.A.W.LF |
| 261407611/66-398 | NLTATSLWG....V.SHLHYP.IGDI | ...........PAL.G.F.M.VI |
| 299137255/65-396 | DLVT.NAWG....I.HHTIYR.VTSV | ...........PEI.N.V.K.GI |
| 237668509/58-389 | STTS.HLLG....L.EKFTFA.LKTN | ...........ITI.D.L.N.FI |
| 182416531/58-389 | STTS.HLLG....L.EKFTFA.LKTN | ...........ITI.D.L.N.FI |
| 288905673/63-391 | SATS.HSLG....L.EKFSHL.VSAD | ...........LTL.D.V.M.IF |
| 306831767/63-391 | SATS.HSLG....L.EKFSHL.VSAD | ...........LTL.D.V.M.IF |
| 125624281/58-389 | SWTS.NYLG....L.EKFSFA.INTN | ...........IHL.D.P.L.VL |
| 306833893/72-400 | SATS.HSLG....L.EKFSHL.VSAD | ...........LTL.D.V.M.TF |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 24379706/63-391 | SYTS.QLLG....L.KNFTHL.IKVH............MTL.N.P.V.LF |
| 223936158/62-409 | DYTC.SAWG....I.KHAIYQ.ISFIEPEA....ASAIFHV.D.A.L.LL |
| 168216344/69-400 | NEIV.KILG....V.HHSHYK.VLGV............PDI.S.A.L.II |
| 281491597/58-389 | SWTS.SSLG....L.EKFSFA.INTN............IHI.D.P.L.VL |
| 116627914/63-392 | STTS.HLLG....L.EKFSHF.VSKS............LTI.D.L.E.TF |
| 290580295/63-391 | SYTS.QLLG....L.KNFTHL.IKVH............MTL.N.P.V.LF |
| 15673080/58-389 | SWTS.SSLG....L.EKFSFA.INTN............IHI.D.P.L.VL |
| 116511937/58-389 | SWTS.NYLG....L.EKFSFA.INTN............IHL.D.P.L.VL |
| 257874163/61-390 | STTS.QWLG....L.EKFSLM.LPQS............VDL.T.I.P.VF |
| 257867835/61-390 | STTS.QWLG....L.EKFSLM.LPQS............VDL.T.I.P.VF |
| 55821189/63-392 | STTS.HLLG....L.EKFSHF.VSKS............LTI.D.L.E.TF |
| 182626550/69-400 | NEVV.KILG....V.HHSHYK.VLGV............PDI.S.V.L.II |
| 110803970/69-400 | NEVV.KNLG....V.HHSHYK.VLGV............PDI.S.A.L.II |
| 55823099/63-392 | STTS.HLLG....L.EKFSHF.VSKS............LTI.D.L.E.TF |
| 209544766/77-424 | DWTC.HAWG....I.HHVTYT.LPFRGYPD...AGGTAFHA.D.P.L.LL |
| 169343074/69-400 | NEVV.KNLG....V.HHSHYK.VLGV............PDI.S.A.F.II |
| 110800437/69-400 | NEVV.KILG....V.HHSHYK.VLGV............PDI.S.V.L.II |
| 168210325/69-400 | NEVV.KILG....V.HHSHYK.VLGV............PDI.S.V.L.II |
| 253755995/54-382 | STTS.HLLG....L.EKFSHT.IATT............S.F.Y.F.T.DS |
| 253754061/54-382 | STTS.HLLG....L.EKFSHT.IATT............S.F.Y.F.T.DS |
| 253752235/54-382 | STTS.HLLG....L.EKFSHT.IATT............S.F.Y.F.T.DS |
| 146321395/54-382 | STTS.HLLG....L.EKFSHT.IATT............S.F.Y.F.T.DS |
| 146319191/54-382 | STTS.HLLG....L.EKFSHT.IATT............S.F.Y.F.T.DS |
| 256423027/87-434 | DIVC.SAWG....I.HHTHYQ.ILFESNHI....SFHFVHF.D.L.L.LL |
| 168207393/69-400 | NEVV.KILG....V.HHSHYK.VLGV............PDI.S.V.L.II |
| 168214512/69-400 | NEVV.KILG....V.HHSHYK.VLGV............PDI.S.A.L.II |
| 18309572/69-400 | NEVV.KILG....V.HHSHYK.VLGV............ADI.S.V.L.II |
| 162149525/77-424 | DWTC.HAWG....I.HHVTYT.LPFRGYPD...AGGTAFHA.D.P.L.LL |
| 196229369/63-411 | DWTC.HAWG....I.GHTHYH.IDFLASNA...APSAFFHL.D.P.K.LL |
| 257876728/61-390 | STTS.QWLG....L.EKFSLM.LPQS............VDL.T.I.P.VF |
| 251797520/69-399 | HLVT.TAWG....I.HHIHYA.MGKV............PDL.T.A.I.VV |
| 195977885/1-309 | SWTS.HCLG....L.EKFSVP.IAKA............LKI.T.P.I.TF |
| 222152807/62-391 | SATS.HRLG....L.EKFSVA.IGNP............EPI.T.L.L.LV |
| 59710638/60-408 | NVVA.SAWG....A.HHTHYL.INFDQVST...LFGHAVDI.D.L.L.LM |
| 167766061/56-388 | AFTS.HILG....L.EKFSVA.IKNT............INL.TGT.K.TI |
| 228476400/63-392 | STTS.HLLG....L.EKFSHF.VSES............LTI.D.L.G.TF |
| 197334244/60-408 | NVVA.SAWG....A.HHTHYL.INFDQVST...LFGHAVDI.D.L.L.LM |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 284005894/64-409 | DITC.AAWG....I.HHIHYQ.VAFSHTA.....IPTFSVP.N.G.W.LL |
| 95928333/62-409 | DLVC.TAWG....I.GHTQYQ.IVAPELHI....DAAVAHV.S.L.V.LA |
| 307277103/61-391 | NFVT.ESFG....V.THTHYP.MGKI...........PTW.S.V.D.LF |
| 171911999/62-407 | DATC.SAWG....V.HHTIYH.LDVAPGA......GSHAAF.Q.A.V.LL |
| 257421896/61-391 | NFVT.ESFG....V.THTHYP.MGKI...........PTW.S.V.E.LF |
| 300779490/57-408 | DITV.SAWK....I.HHTHYH.IDAIPPMDQSFWLSQYIPF.D.L.L.LL |
| 257416700/61-391 | NFVT.ESFG....V.THTHYP.MGKI...........PTW.S.V.D.LF |
| 307271571/61-391 | NFVT.ESFG....V.THTHYP.MGKI...........PTW.S.V.E.LF |
| 300860446/61-391 | NFVT.ESFG....V.THTHYP.MGKI...........PTW.S.V.E.LF |
| 257419916/61-391 | NFVT.ESFG....V.THTHYP.MGKI...........PTW.S.V.E.LF |
| 256963630/61-391 | NFVT.ESFG....V.THTHYP.MGKI...........PTW.S.V.E.LF |
| 256956740/61-391 | NFVT.ESFG....V.THTHYP.MGKI...........PTW.S.V.E.LF |
| 255972070/61-391 | NFVT.ESFG....V.THTHYP.MGKI...........PTW.S.V.E.LF |
| 229549364/61-391 | NFVT.ESFG....V.THTHYP.MGKI...........PTW.S.V.E.LF |
| 149280114/62-411 | DLTV.SAWG....I.HHTAYH.IDLIEKSAY..FLSEYLPV.N.L.L.LL |
| 307290483/61-391 | NFVT.ESFG....V.THTHYP.MGKI...........PTW.S.V.D.LF |
| 256853823/61-391 | NFVT.ESFG....V.THTHYP.MGKI...........PTW.S.V.D.LF |
| 256616980/61-391 | NFVT.ESFG....V.THTHYP.MGKI...........PTW.S.V.D.LF |
| 229545116/61-391 | NFVT.ESFG....V.THTHYP.MGKI...........PTW.S.V.D.LF |
| 257081959/61-391 | NFVT.ESFG....V.THTHYP.MGKI...........PTW.S.V.E.LF |
| 307285753/61-391 | NFVT.ESFG....V.THTHYP.MGKI...........PTW.S.V.E.LF |
| 255975137/61-391 | NFVT.ESFG....V.THTHYP.MGKI...........PTW.S.V.E.LF |
| 257090652/61-391 | NFVT.ESFG....V.THTHYP.MGKI...........PTW.S.V.E.LF |
| 256763156/61-391 | NFVT.ESFG....V.THTHYP.MGKI...........PTW.S.V.E.LF |
| 29376957/61-391 | NFVT.ESFG....V.THTHYP.MGKI...........PTW.S.V.E.LF |
| 227553996/61-391 | NFVT.ESFG....V.THTHYP.MGKI...........PTW.S.V.E.LF |
| 307287657/61-391 | NFVT.ESFG....V.THTHYP.MGKI...........PTW.S.V.D.LF |
| 293387361/61-391 | NFVT.ESFG....V.THTHYP.MGKI...........PTW.S.V.D.LF |
| 293383526/61-391 | NFVT.ESFG....V.THTHYP.MGKI...........PTW.S.V.D.LF |
| 256961242/61-391 | NFVT.ESFG....V.THTHYP.MGKI...........PTW.S.V.D.LF |
| 300731132/63-397 | DLVT.RAWK....V.HHTVYT.VTDV............PTM.S.I.R.GV |
| 257087493/61-391 | NFVT.ESFG....V.THTHYP.MGKI...........PTW.S.V.E.LF |
| 307270777/61-391 | NFVT.ESFG....V.THTHYP.MGKI...........PTW.S.V.E.LF |
| 294780852/61-391 | NFVT.ESFG....V.THTHYP.MGKI...........PTW.S.V.E.LF |
| 257079694/61-391 | NFVT.ESFG....V.THTHYP.MGKI...........PTW.S.V.E.LF |
| 222086761/62-408 | DWTC.HAWG....I.EHVQYH.IAYLAGT.....PASTFHL.D.A.L.LL |
| 257084511/61-391 | NFVT.ESFG....V.THTHYP.MGKI...........PTW.S.V.E.LF |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 240137886/73-417 | DWTC.QAWG....I.HHALYH.VGFLAGT......AKALTV.E.P.V.LL |
| 302024216/54-382 | STTS.HLLG....L.EKFSHT.VATT...........S.F.Y.F.T.DS |
| 222147858/69-416 | DWTC.QAWG....A.SHTHYV.IAYLKNMP....DSGGFHL.D.A.L.IM |
| 293559774/61-391 | NFMT.ESYG....V.SHLHYQ.MGVI...........PEW.S.M.L.LF |
| 260558935/61-391 | NFMT.ESYG....V.SHLHYQ.MGVI...........PEW.S.M.L.LF |
| 257890482/61-391 | NFMT.ESYG....V.SHLHYQ.MGVI...........PEW.S.M.L.LF |
| 154484719/61-393 | SFTS.HSLG....L.EKFAVE.LNET...........INMSD.A.K.TV |
| 227519818/61-391 | NFVT.ESFG....V.THTHYP.MGKI...........PTW.S.V.E.LF |
| 86143630/67-398 | DYFC.QAWN....V.GHTHYH.INSI...........AEM.N.P.A.NL |
| 293568623/61-391 | NFMT.ESYG....V.SHLHYQ.MGVI...........PEW.S.M.L.LF |
| 251778279/66-397 | NIVT.TAFG....V.SHSHYR.ILEV...........PSI.T.Y.I.VV |
| 257886896/61-391 | NFMT.ESYG....V.SHLHYQ.MGVI...........PEW.S.M.L.LF |
| 188588504/66-397 | NIVT.TAFG....V.SHSHYS.ILEV...........PSI.T.Y.I.VV |
| 293571654/61-391 | NFMT.ESYG....V.SHLHYQ.MGVI...........PEW.S.M.L.LF |
| 300863903/61-393 | DRIT.LVLG....L.HHTAYRHAPFV...........PTI.T.P.M.AL |
| 257895467/61-391 | NFMT.ESYG....V.SHLHYQ.MGVI...........PEW.S.M.L.LF |
| 257898081/61-391 | NFMT.ESYG....V.SHLHYQ.MGVI...........PEW.S.M.L.LF |
| 69249390/61-391 | NFMT.ESYG....V.SHLHYQ.MGVI...........PEW.S.M.L.LF |
| 258614354/61-391 | NFMT.ESYG....V.SHLHYQ.MGVI...........PEW.S.M.L.LF |
| 257893085/61-391 | NFMT.ESYG....V.SHLHYQ.MGVI...........PEW.S.M.L.LF |
| 257879974/61-391 | NFMT.ESYG....V.SHLHYQ.MGVI...........PEW.S.M.L.LF |
| 294053809/63-411 | DITC.NSLA....V.HHTHYA.IGYSAREAM..EHFGGIDF.D.L.I.LL |
| 149275805/8-356 | DLSV.TLCG....I.HHTAYH.IDPIITNSN...FLSAYYPV.N.V.V.LI |
| 293553829/61-391 | NFMT.ESYG....V.SHLHYQ.MGVI...........PEW.S.M.L.LF |
| 224023708/79-410 | HLTC.YAWG....V.AHTQYA.IPEV...........PAL.N.V.A.NI |
| 294623042/61-391 | NFMT.ESYG....V.SHLHYQ.MGVI...........PEW.S.M.L.LF |
| 289567585/61-391 | NFMT.ESYG....V.SHLHYQ.MGVI...........PEW.S.M.L.LF |
| 261209457/61-391 | NFMT.ESYG....V.SHLHYQ.MGVI...........PEW.S.M.L.LF |
| 257884112/61-391 | NFMT.ESYG....V.SHLHYQ.MGVI...........PEW.S.M.L.LF |
| 189460046/67-398 | HLTC.HSWG....V.EHTLYP.APVV...........PEL.G.V.S.NI |
| 294620207/61-391 | NFMT.ESYG....V.SHLHYQ.MGVI...........PEW.S.M.L.LF |
| 118579274/62-407 | DQAC.LAWG....L.HHSRYS.VAAV...........APEI.V.G.P.LT |
| 58040573/61-408 | DWAC.RAWG....I.HHASYP.LVFQGTLN...SDGSLSHV.D.I.M.LV |
| 187932697/74-404 | NIVT.TAFG....V.HHSHYS.ILEV...........PTI.T.Y.F.VV |
| 293378332/61-391 | NFMT.ESYG....V.YHLHYQ.MGVI...........PEW.S.M.L.LF |
| 296115670/62-409 | DWVC.HAWG....I.HHTSYH.VASGIIPD...WGGSVFHT.H.P.A.LL |
| 227551941/85-415 | NFMT.ESYG....V.SHLHYQ.MGVI...........PEW.S.M.L.LF |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 294616356/61-391 | NFMT.ESYG....V.SHLHYQ.MGVI............PEW.S.M.L.LF |
| 257883083/61-391 | NFMT.ESYG....V.SHLHYQ.MGVI............PEW.S.M.L.LF |
| 253771312/60-391 | NSVV.SFLG....I.KHSHYI.IKEI............PNL.S.I.I.SA |
| 225166826/60-391 | NSVV.SFLG....I.KHSHYI.IKEI............PNL.S.I.I.SA |
| 307688608/69-400 | NLVT.TVLG....A.KHSHYA.LSGI............PEL.S.T.M.VL |
| 302873225/69-400 | NLVT.TVLG....A.KHSHYA.LSGI............PEL.S.T.M.VL |
| 87306694/62-420 | DQVN.TAWG....I.GHTHYH.IGFAAEIS...SSLSAVSL.D.W.A.LT |
| 88801314/65-397 | NYFC.TVWQ....ISNHTHYT.ISTV............AEL.T.P.I.SV |
| 218283679/62-391 | AYVS.GLFG....L.HKSTFK.IGNV............AEL.N.M.E.LS |
| 240146274/81-413 | AYTS.HTLG....L.EKLYVP.LKDT............LEISD.A.G.MA |
| 197301848/54-386 | AFTS.HILG....L.EKFTAV.IGEK............LDL.SET.K.VI |
| 198275782/67-397 | SMVC.HAWG....V.EHTHYV.VSEV............PFP.E.A.S.NL |
| 304404790/58-390 | DQIT.KAWG....T.EHSHYW.IGIV............PAL.S.L.A.LL |
| 227540545/49-380 | DLIT.KLWN....A.HHTHYH.IDIV............PDL.S.F.W.HI |
| 260771568/62-409 | DVVC.SAVG....A.HHTHYN.IGFAQFNS...LFEHPISI.D.F.I.LT |
| 307818395/70-401 | DIVT.RAWR....V.HHTIYR.VDAL............AGF.T.P.R.TV |
| 300771325/49-380 | DLIT.KLWN....A.HHTHYH.IDIV............PEL.T.F.W.HI |
| 283796370/78-411 | STVS.GALG....L.EKFAFP.VESLN..........GGGL.S.L.S.TV |
| 300778780/74-405 | DLVT.NLWK....V.KHTHYH.IDFV............PKL.E.F.L.PI |
| 283856276/78-422 | DWVC.RLWG....M.DHLRYS.MASFSQ.......MGHFQL.N.I.I.LF |
| 260752944/61-405 | DWVC.RLWG....M.DHLRYS.MASFSQ.......MGHFQL.N.I.I.LF |
| 281418863/57-387 | SCIS.EILG....L.QKSTYF.LDCR............IVP.S.F.S.FI |
| 241761090/61-405 | DWVC.RLWG....M.DHLRYS.MASFSQ.......MGHFQL.N.I.I.LF |
| 255533420/59-389 | AYVT.ELWG....V.GHTHYS.IAFI............LPL.T.F.R.GI |
| 256004137/57-387 | SCIS.EILG....L.QKSTYF.LDCR............IVP.S.F.S.FI |
| 251796733/53-386 | HYTT.LAWG....V.RHLHYS.MGTI............PPP.S.V.M.LL |
| 125974665/60-390 | SCIS.EILG....L.QKSTYF.LDCR............IVP.S.F.S.FI |
| 293374935/63-394 | TYVS.TLFN....V.SHSHYE.METL............SSQ.N.P.F.LF |
| 149197279/60-400 | DQVC.VQWKYPTVV.THTHYL.HPEA............LAL.S.P.S.TL |
| 260584530/57-386 | MNVA.QRLG....L.EKFMVG.ILVD............IQF.D.E...TL |
| 159897555/58-389 | DGVV.RWLN....V.AHSHYH.VGSV............PDL.S.M.I.W. |
| 108757317/55-387 | DMVT.RGLG....I.HHTPYP.APGA............LPL.T.V.A.VL |
| 310817431/55-387 | DLTT.RGLG....I.VHTAYP.APSV............LPL.T.G.G.VL |
| 126645925/55-387 | HLVCANLWG....I.GHTHYS.IPEV............PGF.T.L.I.NF |
| 115376569/2-329 | DLTT.RGLG....I.VHTAYP.APSV............LPL.T.G.G.VL |
| 153853007/62-402 | AFTS.RALG....L.RKFHIN.ILETLN.......YHPSTY.N.A.V.LL |
| 189911881/62-391 | HEVC.LYWK....V.SHSVFP..NVT............FEF.E.S.I.LI |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 183221808/62-391 | HEVC.LYWK....V.SHSVFP..NVT............FEF.E.S.I.LI |
| 146300126/58-389 | YFTV.EFWK....I.KHTHYS.IPVV............PEL.N.F.D.TI |
| 283779250/63-421 | DTTT.TLCG....I.GHTEYK.IAPWMSAA...AGSHLGPL.D.L.V.LL |
| 289639619/53-382 | DSVT.RALG....I.THETYA.ITSV............PAV.G.W.Y.SL |
| 296122614/61-407 | DFVC.TTVG....G.THLHYP.VDWAELN......PSGWLH.R.L.G.IV |
| 241888810/58-377 | AYIS.HKLG....L.EKFFVA.IDVS............EINI.N.L.E.FI | alignment positions 201-250

| | |
|---|---|
| 94994029/66-396 | VKLIGLGLIFGLVGNSFACLLGWFKPYLSQKLPNPYLRIAFIGVLLSICL |
| 217422654/69-400 | ASAVAAGIAFGVVGRLFAAATHGLAALAKRRIAYPPLRPVAGGALVALAA |
| 53722888/61-392 | ASAVAAGIAFGVVGRLFAAATHGLAALAKRRIAYPPLRPVAGGALVALAA |
| 167915998/61-392 | ASAVAAGIAFGVVGRLFAAATHGLAALAKRRIAYPPLRPVAGGALVALAA |
| 254208316/69-400 | ASAVAAGIAFGVVGRLFAAATHGLAALAKRRIAYPPLRPVAGGALVALAA |
| 254202983/69-400 | ASAVAAGIAFGVVGRLFAAATHGLAALAKRRIAYPPLRPVAGGALVALAA |
| 254177294/70-401 | ASAVAAGIAFGVVGRLFAAATHGLAALAKRRIAYPPLRPVAGGALVALAA |
| 124381362/70-401 | ASAVAAGIAFGVVGRLFAAATHGLAALAKRRIAYPPLRPVAGGALVALAA |
| 134278691/61-392 | ASAVAAGIAFGVVGRLFAAATHGLAALAKRRIAYPPLRPVAGGALVALAA |
| 53716487/61-392 | ASAVAAGIAFGVVGRLFAAATHGLAALAKRRIAYPPLRPVAGGALVALAA |
| 167002346/61-392 | ASAVAAGIAFGVVGRLFAAATHGLAALAKRRIAYPPLRPVAGGALVALAA |
| 126447166/61-392 | ASAVAAGIAFGVVGRLFAAATHGLAALAKRRIAYPPLRPVAGGALVALAA |
| 121597200/61-392 | ASAVAAGIAFGVVGRLFAAATHGLAALAKRRIAYPPLRPVAGGALVALAA |
| 126442778/69-400 | ASAVAAGIAFGVVGRLFAAATHGLAALAKRRIAYPPLRPVAGGALVALAA |
| 28896294/62-392 | VKLIGLGLIFGLVGNSFACLLGWFKPYLSQKLPNPYLRIAFIGVLLSICL |
| 21910009/62-392 | VKLIGLGLIFGLVGNSFACLLGWFKPYLSQKLPNPYLRIAFIGVLLSICL |
| 242313952/69-400 | ASAVAAGIAFGVVGRLFAAATHGLAALAKRRIAYPPLRPVAGGALVALAA |
| 126458603/69-400 | ASAVAAGIAFGVVGRLFAAATHGLAALAKRRIAYPPLRPVAGGALVALAA |
| 76818704/69-400 | ASAVAAGIAFGVVGRLFAAATHGLAALAKRRIAYPPLRPVAGGALVALAA |
| 254264654/69-400 | ASAVAAGIAFGVVGRLFAAATHGLAALAKRRIAYPPLRPVAGGALVALAA |
| 226195674/69-400 | ASAVAAGIAFGVVGRLFAAATHGLAALAKRRIAYPPLRPVAGGALVALAA |
| 237508459/69-400 | ASAVAAGIAFGVVGRLFAAATHGLAALAKRRIAYPPLRPVAGGALVALAA |
| 167724759/61-392 | ASAVAAGIAFGVVGRLFAAATHGLAALAKRRIAYPPLRPVAGGALVALAA |
| 254186015/61-392 | ASAVAAGIAFGVVGRLFAAATHGLAALAKRRIAYPPLRPVAGGALVALAA |
| 167829250/61-392 | ASAVAAGIAFGVVGRLFAAATHGLAALAKRRIAYPPLRPVAGGALVALAA |
| 254184798/61-392 | ASAVAAGIAFGVVGRLFAAATHGLAALAKRRIAYPPLRPVAGGALVALAA |
| 167850723/61-392 | ASAVAAGIAFGVVGRLFAAATHGLAALAKRRIAYPPLRPVAGGALVALAA |
| 167743705/61-392 | ASAVAAGIAFGVVGRLFAAATHGLAALAKRRIAYPPLRPVAGGALVALAA |
| 257141781/61-392 | ASAVAAGIAFGIVGRLFAAATHALGAFAKRRIAYAPLRPVAGGALVALAA |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 167615218/61-392 | ASAVAAGIAFGIVGRLFAAATHALGAFAKRRIAYAPLRPVAGGALVALAA |
| 254194484/61-392 | ASAVAAGIAFGVVGRLFAAATHGLAALAKRRIAYPPLRPVAGGALVALAA |
| 167907659/61-392 | ASAVAAGIAFGVVGRLFAAATHGLAALAKRRIAYPPLRPVAGGALVALAA |
| 254301074/61-392 | ASAVAAGIAFGVVGRLFAAATHGLAALAKRRIAYPPLRPVAGGALVALAA |
| 167923842/61-392 | ASAVAAGIAFGVVGRLFAAATHGLAALAKRRIAYPPLRPVAGGALVALAA |
| 167577039/61-392 | ASAVAAGIAFGIVGRLFAAATHALGAFAKRRIAYAPLRPVAGGALVALAA |
| 94990116/66-396 | VKLIGLGLIFGLVGNSFACLLGWFKPYLSQKLPNPYLRIAFIGVLLSICL |
| 83716137/69-400 | ASAVAAGIAFGIVGRLFAAATHALGAFAKRRIAYAPLRPVAGGALVALAA |
| 94988234/66-396 | VKLIGLGLIFGLVGNSFAYLLGWFKPYLSQKLPNPYFRIAFIGALLSICL |
| 71903194/66-396 | VKLIGLGLIFGLVGNSFAYLLGWFKPYLSQKLPNPYFRIAFIGALLSICL |
| 94992108/66-396 | VKLIGLGLIFGLVGNSFAYLLGWFKPYLSQKLPNPYFRIAFIGALLSICL |
| 306827662/62-392 | VKLIGLGLIFGLVGNSFACLLGWFKPYLSQKLPNPYLRIAFIGVLLSICL |
| 19745820/62-392 | VKLIGLGLIFGLVGNSFACLLGWFKPYLSQKLPNPYLRIAFIGVLLSICL |
| 139474077/62-392 | VKLIGLGLIFGLVGNSFACLLGWFKPYLSQKLPNPYLRIAFIGVLLSICL |
| 71910363/62-392 | VKLIGLGLIFGLVGNSFAYLLGWFKPYLSQKLPNPYFRIAFIGALLSICL |
| 50913916/66-396 | VKLIGLGLIFGLVGNSFAYLLGWFKPYLSQKLPNPYLRIAFIGVLLSICL |
| 209559106/62-392 | VKLIGLGLIFGLVGNSFAYLLGWFKPYLSQKLPNPYFRIAFIGALLSICL |
| 15674779/62-392 | VKLIGLGLIFGLVGNSFAYLLGWFKPYLSQKLPNPYFRIAFIGALLSICL |
| 167566636/61-392 | ASAVAAGIAFGVVGRLFAAATHALGALAKRWIAYPPLRPVAGGALVALAA |
| 167573712/61-392 | ASAVAAGIAFGVVGRLFAAATHALGALAKRWIAYPPLRPVAGGALVALAA |
| 251782109/62-392 | VKLIGLGLIFGLVGNSFAYLLGWFKPYLSQKLPNPYFRIAFIGALLSICL |
| 66768521/61-392 | LAVMAAGVVFGLVGRLFATATHLLGQSVKQAIAYAPLRPLLGGVVIALAV |
| 21231425/61-392 | LAVMAAGVVFGLVGRLFATATHLLGQSVKQAIAYAPLRPLLGGVVIALAV |
| 188991670/81-412 | LAVMAAGVVFGLVGRLFATATHLLGQSVKQAIAYAPLRPLLGGVVIALAV |
| 221210981/61-392 | AATVVAGIAFGVVGRLFAHATHALAAGFRRAIRYAPLQPVLGGVLVAAAA |
| 189352355/61-392 | AATVVAGIAFGVVGRLFAHATHALAAGFRRTIRYAPLQPVLGGVLVAAAA |
| 161521476/61-392 | AATVVAGIAFGVVGRLFAHATHALAAGFRRTIRYAPLQPVLGGVLVAAAA |
| 221203824/61-392 | AATVVAGIAFGAVGRLFAHATHALAAGFRRAIRYAPLQPVLGGVLVAAAA |
| 221197152/61-392 | AATVVAGIAFGAVGRLFAHATHALAAGFRRAIRYAPLQPVLGGVLVAAAA |
| 77408502/58-387 | LKLLVLGLCFGLCGNLFAYLLAKAKLIASSRLLNPYKRIFTLGLLATFLL |
| 167583829/60-391 | GATVVAGIAFGVVGRLFAHATHALSALFRRRIRYAPLQPVVGGLLVAVAA |
| 77411121/58-387 | LKLLVLGLCFGLCGNLFAYLLAKAKLIASSRLLNPYKRIFTLGLLATFLL |
| 76798380/58-387 | LKLLVLGLCFGLCGNLFAYLLAKAKLIASSRLLNPYKRIFTLGLLATFLL |
| 76787827/58-387 | LKLLVLGLCFGLCGNLFAYLLAKAKLIASSRLLNPYKRIFTLGLLATFLL |
| 25010655/58-387 | LKLLVLGLCFGLCGNLFAYLLAKAKLIASSRLLNPYKRIFTLGLLATFLL |
| 22536719/58-387 | LKLLVLGLCFGLCGNLFAYLLAKAKLIASSRLLNPYKRIFTLGLLATFLL |
| 170701178/116-447 | AATVVAGVAFGVVGRLFAFATHALTAWFRRVVRHATLQPVLGGAIVAVAA |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 134292888/61-392 | AATVVAGVAFGVVGRLFAFATHALTAWFRRVVRYAPLQPVLGGAMVAVAA |
| 115360262/61-392 | AATVVAGVAFGVVGRLFAFATHALTAWFRRVVRHAPLQPVLGGAIVAVAA |
| 172062717/116-447 | AATVVAGVAFGVVGRLFAFATHALTGWFRRVVRHAPLQPVLGGAIVAVAA |
| 170736113/61-392 | AVTVVAGIAFGVVGRLFAFATHVLTAWFRRVIRHAPLQPVVGGLLVAVAA |
| 254248860/130-461 | AVTVVAGIAFGVVGRLFAFATHALTAWFRRVIRHAPLQPVVGGLLVAVAA |
| 206562684/116-447 | AVTVVAGIAFGVVGRLFAFATHALTAWFRRVIRYAPLQPVLGGLMVAVAA |
| 116691890/61-392 | AVTVVAGIAFGVVGRLFAFATHALTAWFRRVIRHAPLQPVLGGLLVAVAA |
| 107026913/61-392 | AVTVVAGIAFGVVGRLFAFATHALTAWFRRVIRHAPLQPVLGGLLVAVAA |
| 78063149/61-392 | AVTVVAGIAFGVVGRLFAFATHALTAWFRRVVRYAPLQPVLGGLLVAAAA |
| 224824608/61-392 | AATVIAGMLFGLTGKVFADLTHGLGGWIKQRIGYAPLRPLLGGMVIAAAV |
| 300697592/50-381 | GAAVVAGIVFGVAGMTFAELTHRLSRALKQRIPFGPLRPLLGGGVVAAAS |
| 187925675/61-392 | GSVILAGIAFGVVGMLFADSTHALSAFIKRQIAYAPARPFVGGLVVALAA |
| 160897178/61-392 | VAVIIAGILFGLVGMLFATAVHKIGALVKHLIAYPPLRPFFGGLVIATAV |
| 207739311/50-381 | SAAVVAGIVFGVAGMTFAELTHRLSRALKQRIPFGPLRPLLGGGVVAAAS |
| 300311782/61-392 | AAVIAAGVVFGLAGMIFANSTHTLSAFMKRHVSYAPLRPFIGGFIVALAV |
| 83748726/62-393 | SAAVVAGIVFGVAGMTFAELTHRLSRALKQRIPFGPLRPLLGGGVVAAAS |
| 17546522/50-381 | GAVVVAGIVFGLAGMTFAELTHRLGRWLKKRIPFGPLRPVLGGCVVAAAA |
| 207724636/50-381 | GAAVVAGIVFGVAGMTFAELTHRLSRALKQRIPFGPLRPLLGGGVVAAAS |
| 166712100/61-392 | LAVMAAGMLFGLVGMLFATVTHRLGNVSKRAIGYAPLRPLLGGCIIALAV |
| 84624054/61-392 | LAVMAAGMLFGLVGMLFATVTHRLGNVSKRAIGYAPLRLLLGGCIIALAV |
| 58582162/61-392 | LAVMAAGMLFGLVGMLFATVTHRLGNVSKRAIGYAPLRLLLGGCIIALAV |
| 188576912/61-392 | LAVMAAGMLFGLVGMLFATVTHRLGNVSKRAIGYAPLRLLLGGCIIALAV |
| 188576721/61-392 | LAVMAAGMLFGLVGMLFATVTHRLGNVSKRAIGYAPLRLLLGGCIIALAV |
| 237728386/61-392 | LSVVIAGAVFGLAGMVFSVATGKASGIVKRYIKYAPLRPFFGGILIAAAV |
| 34497884/61-392 | CASVLAGAAFGLTGKLFAESVHWLADCLRRIAFAPLRPLIGGGAIAVAA |
| 285018239/61-392 | ISVVAAGIVFGLIGMLFATATHRFGAVVKRAIGYAPLRPAIGGIVIATAV |
| 66044733/61-398 | MAVVAAGIVFGLTGLLFATATHKLGAFVKRLITYSPLRPFAGGLLIAVAV |
| 213971827/61-398 | MAVVAAGIVFGLTGLLFATATHKLGAFVKRLITYSPLRPFAGGLLIAVAV |
| 171058747/61-392 | TAVVLAGIVFGLVGMLFAQATHAGAAVVRRHVGYPPLRPLFGGAAIAVVI |
| 238025034/95-426 | ASAIIAGLAFGVVGMLFADATHALGARFKRWIPYAPLRPVAGGALVALAG |
| 229589423/61-398 | MAVVAAGIIFGLTGLLFATTTHKLGAFVKRLISYSPLRPFAGGLLIAVAV |
| 300693842/50-381 | GAVVVAGIVFGLAGMTFAELTHRTGRALKKRIPFGPLRPVLGGCVVAAAG |
| 28871751/65-402 | MAVVAAGIVFGLTGLLFATATHKLGAFVKRLITYSPLRPFAGGLLIAVAV |
| 237801960/61-398 | MAVVAAGIVFGLTGLLFATATHKLGAFVKRLITYSPLRPFAGGLLIAVVV |
| 241665656/62-393 | GLVVVAGIVFGLAGMTFAALTHRLSRLLKRHIAFGPLRPVLGGSVVAAA |
| 187926168/62-393 | GLVVVAGIVFGLAGMTFAALTHRLSRLLKRHIAFGPLRPVLGGSVVAAA |
| 302059036/73-410 | MAVVAAGIVFGLTGLLFATATHKLGAFVKRLITYSPLRPFAGGLLIAVAV |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 309779037/62-393 | GLVVVAGIVFGLAGMTFAALTHRLSRLLKHHIAFGPLRPVLGGSVVVAAA |
| 126698234/62-390 | WKLIVLGIIFGMVGGAFAWCLKLSKRKIGNRLKNPMIRIAIIGVCLSVLF |
| 306519283/74-402 | WKLIVLGIIFGMVGGAFAWCLKLSKRKIGNRLKNPMIRIAIIGVCLSVLF |
| 260685949/74-402 | WKLIVLGIIFGMVGGAFAWCLKLSKRKIGNRLKNPMIRIAIIGVCLSVLF |
| 260682350/74-402 | WKLIVLGIIFGMVGGAFAWCLKLSKRKIGNRLKNPMIRIAIIGVCLSVLF |
| 255649173/74-402 | WKLIVLGIIFGMVGGAFAWCLKLSKRKIGNRLKNPMIRIAIIGVCLSVLF |
| 255516076/74-402 | WKLIVLGIIFGMVGGAFAWCLKLSKRKIGNRLKNPMIRIAIIGVCLSVLF |
| 255313389/74-402 | WKLIVLGIIFGMVGGAFAWCLKLSKRKIGNRLKNPMIRIAIIGVCLSVLF |
| 255091661/74-402 | WKLIVLGIIFGMVGGAFAWCLKLSKRKIGNRLKNPMIRIAIIGVCLSVLF |
| 254974264/74-402 | WKLIVLGIIFGMVGGAFAWCLKLSKRKIGNRLKNPMIRIAIIGVCLSVLF |
| 225868779/61-391 | GKLVLLGLIFGLAGNLFASLLARAKPYIAARLPNPYYRVLLVGGFLSLSL |
| 255099763/74-402 | WKLIVLGIIFGMVGGAFAWCLKLSKRKIGNRLKNPMIRIAIIGVCLSVLF |
| 255305648/74-402 | WKLIVLGIIFGMVGGAFAWCLKLSKRKIGNRLKNPMIRIAIIGVCLSVLF |
| 225870265/61-391 | GKLVLLGLIFGLAGNLFASLLARAKPYIAARLPNPYYRVLLVGGFLSLSL |
| 296878238/74-402 | WKFIALGIIFGMVGGAFAWCLKLSKRKICNRLKNPMIRIAIIGACISILF |
| 296449441/74-402 | WKFIALGIIFGMVGGAFAWCLKLSKRKICNRLKNPMIRIAIIGACISILF |
| 255654699/74-402 | WKFIALGIIFGMVGGAFAWCLKLSKRKICNRLKNPMIRIAIIGACISILF |
| 296876619/58-390 | IKVALLGLAFGLAGKLFAVSLSWLKKTVAQVLPNPYIRIALIGAGLSLVL |
| 163790421/57-388 | VKMIFLGMIFGIVGGLFAYVLGYSKQFIGKKIPNLSKRIFFVGILISLLL |
| 24379705/63-392 | IQLLILGLIFGLAGNLFAFLLAWCKQVQARLLPNLYRRIFIVGLLLSLLF |
| 290580296/63-392 | IQLLILGLIFGLAGNLFAFLLAWCKQVQARLLPNLYRRIFIVGLLLSLLF |
| 171780017/63-391 | CKLALLGLIFGLVGNAFAALLAYAKQKAKEVMDNPYYRILFGGIVLSLLF |
| 261407611/66-398 | MKVVFASMLFGLTSRLFSELTHSLKRWYGFVFHNPMVKSAAGGVIIIGLV |
| 299137255/65-396 | LAAMAAGAAFGLVGMAFAKTTHAISHFVRSRIPFAPLRPAAGGILVTAAV |
| 237668509/58-389 | IKLALIGIIFGVVGGLFAHVLGKMKKILGDLIKNPILKIFVIGIILSILL |
| 182416531/58-389 | IKLALIGIIFGVVGGLFAHVLGKMKKILGDLIKNPILKIFVIGIILSILL |
| 288905673/63-391 | CKLAVLGIIFGLVGNLFAKLLAIAKEKAKDVMDNPYYRILFGGILLSLIF |
| 306831767/63-391 | CKLAVLGIIFGLVGNLFAKLLAIAKEKAKDVMDNPYYRILFGGILLSLIF |
| 125624281/58-389 | LKLAIIAVCFGLVGRFFAESLAFMKATVAKRIANPYQRIILMGIVISIGL |
| 306833893/72-400 | CKLAVLGIIFGLVGNLFAKLLAIAKEKAKDVMDNPYYRILFGGILLSLIF |
| 24379706/63-391 | VKFALLGIIFGLVGTSFAYLLRRTKLSLILRFKRPYQRIMIVGLLLSVLF |
| 223936158/62-409 | LKAVTAGIAFGLCSLLFSELAHSLQKAYKKLVPLAPLRPVLGGVMVIALV |
| 168216344/69-400 | LKVIISAICFGLASRLFSELTHKLKGLFSNKFKNTSLKSFVGGCIVILLV |
| 281491597/58-389 | LKLAVIAVCFGLVGRFFAESLAFMKATVAKRIVNPYYRIILMGIVISIGL |
| 116627914/63-392 | MKLALLGLAFGLAGNLFAYLLSLAKKKVASLLPNPYYRVLLGGVVLTCLL |
| 290580295/63-391 | VKFALLGIIFGLVGTSFAYLLRRTKLSLILRFKRPYQRIMIVGLLLSVLF |
| 15673080/58-389 | LKLAVIAVCFGLVGRFFAESLAFMKATVAKRIVNPYYRIILMGIVISIGL |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 116511937/58-389 | LKLAIIAVCFGLVGRFFAESLAFMKATVAKRIANPYQRIILMGIVISIGL |
| 257874163/61-390 | LKLLVIGLIFGMVGGSFAGCLETMKRIMKRRFPNPLWRIGIGALALVLLF |
| 257867835/61-390 | LKLLVIGLIFGMVGGSFAGCLETMKRIMKRRFPNPLWRIGIGALALVLLF |
| 55821189/63-392 | MKLALLGLAFGLAGNLFAYLLSLAKKKVASLLPNPYYRVLLGGVVLTCLL |
| 182626550/69-400 | LKVIISAICFGLASRLFSELTHKLKGLFSNKFKNTSLKSFVGGCIVILLV |
| 110803970/69-400 | LKVIISAICFGLASRLFSELTHKLKKVFSNKFKNTSLKSFVGGCIVILLV |
| 55823099/63-392 | MKLALLGLAFGLAGNLFAYLLSLAKKKVASLLPNPYYRVLLGGVVLTCLL |
| 209544766/77-424 | ARVAAAGVAFGLASLAFAQAVHRLGAVFRALCPVAWLRPAIGGVLTIVLV |
| 169343074/69-400 | LKVIISAICFGLASRLFSELTHKLKGLFSNKFKNTSLKSFVGGCIVILLV |
| 110800437/69-400 | LKVIISAICFGLASRLFSELTHKLKGLFSNKFKNTSLKSFVGGCIVILLV |
| 168210325/69-400 | LKVIISAICFGLASRLFSELTHKLKGLFSNKFKNTSLKSFVGGCIVILLV |
| 253755995/54-382 | FKWLFIALCFGFIGNLFALFLAQAKSISTRWLPNPYIKIAIMGVGLTVLL |
| 253754061/54-382 | FKWLFIALCFGFIGNLFALFLAQAKSISTRWLPNPYIKIAIMGVGLTVLL |
| 253752235/54-382 | FKWLFIALCFGFIGNLFALFLAQAKSISTRWLPNPYIKIAIMGVGLTVLL |
| 146321395/54-382 | FKWLFIALCFGFIGNLFALFLAQAKSISTRWLPNPYIKIAIMGVGLTVLL |
| 146319191/54-382 | FKWLFIALCFGFIGNLFALFLAQAKSISTRWLPNPYIKIAIMGVGLTVLL |
| 256423027/87-434 | IKVIACGIAFGLASFLFATCMRNIKSYAKAWIKIPLLIPAIGGLIVIGGC |
| 168207393/69-400 | LKVIISAICFGLASRLFSELTHKLKGLFSNKFKNTSLKSFVGGCIVILLV |
| 168214512/69-400 | LKVIISAICFGLASRLFSELTHKLKKIFSNKFKNTSLKSFVGGCIVILLV |
| 18309572/69-400 | LKVIISAICFGLASRLFSELTHKLKGLFSNKFKNTSLKSFVGGCIVILLV |
| 162149525/77-424 | ARVAPAGVAFGLASLAFAQAVHRLGAVFRALCPVAWLRPAIGGVLTIVLV |
| 196229369/63-411 | LKVVVASAAFGMASTAFSELSHRLSALFKRLVPYGPWRPAVGGLVVIGLF |
| 257876728/61-390 | LKLLVIGLIFGMVGGSFAGCLETMKRIMKRRFPNPLWRIGIGALALALLF |
| 251797520/69-399 | IKVVFASIIFGLASIMFSELTHWLKKTFSKLFKNPVIKTFIGGVVVIVLV |
| 195977885/1-309 | GKLVLLGLIFGLVGNLFAFLLARAKPYIAARLSNPYYRVLLVGSILSLSL |
| 222152807/62-391 | LKLALLGLLFAVAGNVFAYLLSYGKNLLAERFPNPYLRIAVMGLLLSLLL |
| 59710638/60-408 | AKVIIAAIGFGIAGYLFGELTHGFKDLFNATLKNPYLIVVVGGLMVIIIT |
| 167766061/56-388 | ISVIILGILFGLTGRLFSFSLSKLKVFMGETIMNQYLRIGVMAIPLAALL |
| 228476400/63-392 | MKLALLGLAFGLAGNLFAYLLSLAKKKVVSLLPNPYYRVLLGSVVLTCLL |
| 197334244/60-408 | AKVIIAAIGFGIAGYLFGELTHGFKDLFNATLKNPYLIVVVGGLMVIIIT |
| 284005894/64-409 | TKVALAGALFGLAALVFSELTHGLQRLYKTYLPSTYLRPIIGGVLLIGLV |
| 95928333/62-409 | AKVMLASILFGLAGFLFAEITHALSGLFKKYVTRYWLRPVIGAVVVLGIS |
| 307277103/61-391 | VKLFLASICFGLAGWVFSRSIVFLKKTYANWFANVYLRAFLGASIVVLFV |
| 171911999/62-407 | VKVAGSAICFGLASRLFSEVTHGLQRCFARLLPFAPLRPVLGGLLVIGLV |
| 257421896/61-391 | VKLFLASICFGLAGWVFSRSIVFLKKTYANWFANVYLRAFLGASIVVLFV |
| 300779490/57-408 | GKIIIASIAFGLASFIFAEMAHRIKNVMVASVSKKWLIPVIGGCVIILLT |
| 257416700/61-391 | VKLFLASICFGLAGWVFSRSIVFLKKTYANWFANVYLRAFLGAAIVVLFV |

TABLE 6-continued

Sequences and alignments of examples of fluoride transporters. The first column lists the GI number for the protein in the NCBI RefSeq database and, following the slash, the amino acids positions of the protein that are aligned in the table.

| GI/positions | Sequence |
|---|---|
| 307271571/61-391 | VKLFLASICFGLAGWVFSRSIVFLKKTYANWFANVYLRAFLGASIVVLFV |
| 300860446/61-391 | VKLFLASICFGLAGWVFSRSIVFLKKTYANWFANVYLRAFLGASIVVLFV |
| 257419916/61-391 | VKLFLASICFGLAGWVFSRSIVFLKKTYANWFANVYLRAFLGASIVVLFV |
| 256963630/61-391 | VKLFLASICFGLAGWVFSRSIVFLKKTYANWFANVYLRAFLGASIVVLFV |
| 256956740/61-391 | VKLFLASICFGLAGWVFSRSIVFLKKTYANWFANVYLRAFLGASIVVLFV |
| 255972070/61-391 | VKLFLASICFGLAGWVFSRSIVFLKKTYANWFANVYLRAFLGASIVVLFV |
| 229549364/61-391 | VKLFLASICFGLAGWVFSRSIVFLKKTYANWFANVYLRAFLGASIVVLFV |
| 149280114/62-411 | SKVILASTLFGLASYLFAVMVHEIKAFFSKVCKIQWLIPVIGGLIIIGLT |
| 307290483/61-391 | VKLFLASICFGLAGWVFSRSIVFLKKTYANWFANVYLRAFLGASIVVLFV |
| 256853823/61-391 | VKLFLASICFGLAGWVFSRSIVFLKKTYANWFANVYLRAFLGASIVVLFV |
| 256616980/61-391 | VKLFLASICFGLAGWVFSRSIVFLKKTYANWFANVYLRAFLGASIVVLFV |
| 229545116/61-391 | VKLFLASICFGLAGWVFSRSIVFLKKTYANWFANVYLRAFLGASIVVLFV |
| 257081959/61-391 | VKLFLASICFGLAGWVFSRSIVFLKKTYANWFANVYLRAFLGAAIVVLFV |
| 307285753/61-391 | VKLFLASICFGLAGWVFSRSIVFLKKTYANWFANVYLRAFLGASIVVLFV |
| 255975137/61-391 | VKLFLASICFGLAGWVFSRSIVFLKKTYANWFANVYLRAFLGASIVVLFV |
| 257090652/61-391 | VKLFLASICFGLAGWVFSRSIVFLKKTYANWFANVYLRAFLGAAIVVLFV |
| 256763156/61-391 | VKLFLASICFGLAGWVFSRSIVFLKKTYANWFANVYLRAFLGAAIVVLFV |
| 29376957/61-391 | VKLFLASICFGLAGWVFSRSIVFLKKTYANWFANVYLRAFLGAAIVVLFV |
| 227553996/61-391 | VKLFLASICFGLAGWVFSRSIVFLKKTYANWFANVYLRAFLGAAIVVLFV |
| 307287657/61-391 | VKLFLASICFGLAGWVFSRSIVFLKKAYANWFANVYLRAFLGAAIVVLFV |
| 293387361/61-391 | VKLFLASICFGLAGWVFSRSIVFLKKAYANWFANVYLRAFLGAAIVVLFV |
| 293383526/61-391 | VKLFLASICFGLAGWVFSRSIVFLKKAYANWFANVYLRAFLGAAIVVLFV |
| 256961242/61-391 | VKLFLASICFGLAGWVFSRSIVFLKKAYANWFANVYLRAFLGAAIVVLFV |
| 300731132/63-397 | AYAMIAGAIFGLAGMCFARLTHAVSHLAKKYIVNPPLRPVAGGLLVTIAV |
| 257087493/61-391 | VKLFLASICFGLAGWVFSRSIVFLKKTYANWFANVYLRAFLGAAIVVLFV |
| 307270777/61-391 | VKLFLASICFGLAGWVFSRSIVFLKKTYANWFANVYLRAFLGASIVVLFV |
| 294780852/61-391 | VKLFLASICFGLAGWVFSRSIVFLKKTYANWFANVYLRAFLGASIVVLFV |
| 257079694/61-391 | VKLFLASICFGLAGWVFSRSIVFLKKTYANWFANVYLRAFLGASIVVLFV |
| 222086761/62-408 | LKVGIAGVLFGLMARCFSEISHRMSAVFKKICAYAPLRSVIASIVLIGLV |
| 257084511/61-391 | VKLFLASICFGLAGWVFSRSIVFLKKTYANWFANVYLRAFLGAAIVVLFV |
| 240137886/73-417 | AKVALAGVAFGLVGLLFAEANHVLGGWLKRLVPYGPLRPVIGGLAVIGLV |
| 302024216/54-382 | FKWLFIALCFGFIGNLFAWFLAQAKSISTRWLPNPYIKIAIMGVGLTVLL |
| 222147858/69-416 | LKVVFAGAVFGLAAHGFAEISHLAGAAYKALLPSAPLRPVLASAILLALV |
| 293559774/61-391 | FKVFVAGIAFGLIGWVFSRSIVFLKARYAQWIPHPVWRNTIGGAVVVAAA |
| 260558935/61-391 | FKVFVAGIAFGLIGWVFSRSIVFLKARYAQWIPHPVWRNTIGGAVVVAAA |
| 257890482/61-391 | FKVFVAGIAFGLIGWVFSRSIVFLKARYAQWIPHPVWRNTIGGAVVVAAA |
| 154484719/61-393 | IIIIILGLAFGIVGRIFSYLLQLLKKIMAEKIVNPYLRIGLVSIPLAIIL |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 227519818/61-391 | VKLFLASICFGLAGWVFSRSIVFLKKTYANWFANVYLRAFLGASIVVLFV |
| 86143630/67-398 | LWALLAGIIFGLVSMLFSKSTHFWSSQFKKYIKYPPLRPFIGGVVIAIAV |
| 293568623/61-391 | FKVFVAGIAFGLIGWVFSRSIVFLKARYAQWIPHPVWRNTIGGAVVVAAA |
| 251778279/66-397 | FKVIVAAILFGLVSKFFSEFTHKLKDIFSSTFKNSAIKSMVGGFIVIILT |
| 257886896/61-391 | FKVFVAGIAFGLIGWVFSRSIVFLKARYAQWIPHPVWRNTIGGAVVVAAA |
| 188588504/66-397 | FKVIVAAILFGLVSKFFSEFTHKLKDIFSSTFKNSAIKSMVGGFIVIILT |
| 293571654/61-391 | FKVFVAGIAFGLIGWVFSRSIVFLKARYAQWIPHPVWRNTIGGAVVVAAA |
| 300863903/61-393 | ISAIIAGAIFGIVAMIFAKLTHKISHFFKAKISYPPLRPAIGGTIVVLSV |
| 257895467/61-391 | FKVFVAGIAFGLIGWVFSRSIVFLKARYAQWIPHPVWRNTIGGAVVVAAA |
| 257898081/61-391 | FKVFVAGIAFGLIGWVFSRSIVFLKARYAQWIPHPVWRNTIGGAVVVAAA |
| 69249390/61-391 | FKVFVAGIAFGLIGWVFSRSIVFLKARYAQWIPHPVCRNTIGGAVVVAAA |
| 258614354/61-391 | FKVFVAGIAFGLIGWVFSRSIVFLKARYAQWIPHPVCRNTIGGAVVVAAA |
| 257893085/61-391 | FKVFVAGIAFGLIGWVFSRSIVFLKARYAQWIPHPVCRNTIGGAVVVAAA |
| 257879974/61-391 | FKVFVAGIAFGLIGWVFSRSIVFLKARYAQWIPHPVCRNTIGGAVVVAAA |
| 294053809/63-411 | LKVLLASACFGLASFFFAELSHGLKALSQAFLKPWWLPPVLAAVLVLGIS |
| 149275805/8-356 | MKITFSAVCFGLSSYLFVFLIHQIKAFSIKMIRVQWLIPVFGAAVLILMT |
| 293553829/61-391 | FKVFVAGIAFGLIGWVFSRSIVFLKARYAQWIPHPVWRNTIGGAVVVAAA |
| 224023708/79-410 | LWVALAGVLFGLVAMLFSRSIGFWGGLARRYVSYPPLRPFWGGILIALAV |
| 294623042/61-391 | FKVFVAGIAFGLIGWVFSRSIVFLKARYAQWIPHPVWRNTIGGAVVVAAA |
| 289567585/61-391 | FKVFVAGIAFGLIGWVFSRSIVFLKARYAQWIPHPVWRNTIGGAVVVAAA |
| 261209457/61-391 | FKVFVAGIAFGLIGWVFSRSIVFLKARYAQWIPHPVWRNTIGGAVVVAAA |
| 257884112/61-391 | FKVFVAGIAFGLIGWVFSRSIVFLKARYAQWIPHPVWRNTIGGAVVVAAA |
| 189460046/67-398 | LWVALSGIVFGVVAMAFSRSIGFWGGVAKKFISYPPLRPVAGGIIIALAV |
| 294620207/61-391 | FKVFVAGIAFGLIGWVFSRSIVFLKARYAQWIPHPVWRNTIGGAVVVAAA |
| 118579274/62-407 | LKVILAAIAFGLASVLFAELIHGISHIFKRTVSRPWLRPVLGGLLVIALT |
| 58040573/61-408 | VRVAIAALAFGLLSRVFAESVHLLAAFMKKLCKTPWLRPAIGGILTILLV |
| 187932697/74-404 | LKIIIAAILFGLVSKLFSELTHKLKDIFSSRFENAAIKSMVGGFIIIILT |
| 293378332/61-391 | FKVFVAGIAFGLIGWVFSRSIVFLKARYAQWIPHPVWRNTIGGAVVVAAA |
| 296115670/62-409 | IKVGLAAICFGLTSLLFAEGIHRLTPLVRRACPVPWLRPAIGGVATILLV |
| 227551941/85-415 | FKVFVAGIAFGLIGWVFSRSIVFLKARYAQWIPHPVWRNTIGGAVVVAAA |
| 294616356/61-391 | FKVFVAGIAFGLMGWAFSRSIVFLKARYAQWIPHPVWRNTIGGAVVVAAA |
| 257883083/61-391 | FKVFVAGIAFGLIGWVFSRSIVFLKARYAQWIPHPVWRNTIGGAVVVAAA |
| 253771312/60-391 | FKIVLASIVFGLISRLFSKLTHKLKYIFSKLFKNIFIKSFIGGIFVIVLT |
| 225166826/60-391 | FKIVLASIVFGLISRLFSKLTHKLKYIFSKLFKNIFIKSFIGGIFVIVLT |
| 307688608/69-400 | LKVIIASLLFGLVSILFSEGIHSCKKIFSKLFKNPMIKSIIGGVIIILLT |
| 302873225/69-400 | LKVIIASLLFGLVSILFSEGIHSCKKIFSKLFKNPMIKSIIGGVIIILLT |
| 87306694/62-420 | GKVAIAAIFFGLASVLFAELTHAISGTAKRFIAIPWLRPAVGGCVVIALV |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 88801314/65-397 | LWSLFAGIIFGLVSLLFSKSTHLWTGLFKKYISYPPLRPVIGGIFLAITV |
| 218283679/62-391 | IKLLVLGILFGMVGGLFAYFLKHTKAFVTNKITNPYKRIFMMGIIVAILL |
| 240146274/81-413 | VRLIVLGIIFGLTGRLFSFLLAKSKKFFGEKIKNPYFRIGVISIPLALIL |
| 197301848/54-386 | LSLIVLGILFGLVGRLFSGTLQWMKKRMGNAIKNPYIRIGAVAVFLAVLL |
| 198275782/67-397 | LWTIGAGILFGLAAMLFSRSIGFWSGM.AKRISYPPFRPLIGGLVIAAAV |
| 304404790/58-390 | LKVIGASVLFGLAALIFSQLTHFLKAWFTRLIPYAPAKSFVGGVLVIALV |
| 227540545/49-380 | TLAIFAGILFGLCATVFSRTLKRTAQLFKSYISYPPLRPFTGGIIVAAAV |
| 260771568/62-409 | GKILIAGVIFGLVGLLFSELTSGLKAWFLRRLRNPYLIVFCGGLLVIAIV |
| 307818395/70-401 | LASVLAGALFGLMALIFSYGVHHLSSWSKKLVRFGPLRPAIGGVIIATAV |
| 300771325/49-380 | TLAVFAGILFGLCATVFSRTLKRTAQLFKSYISYPPLRPFIGGIIVAAAV |
| 283796370/78-411 | FLLLGAGLIFGTVGGAFAWTLGRLKKGLGEAVKNPVVRIAVCSAGLSILL |
| 300778780/74-405 | LYSILAGIAFGICAAAFSKIIHWMGSFFKSKVKYPPLRPVAGGIIIALAV |
| 283856276/78-422 | FKVILASIAFGVIARLFSESLANSAQWFKKVIPSAPLISFTGGLIVIALV |
| 260752944/61-405 | FKVILASIAFGVIARLFSESLANSAQWFKKVIPSAPLISFTGGLIVIALV |
| 281418863/57-387 | MKIIVLGVLFGLTGMLFSILLKKLRALLTNYIKNNIIRIFVFGTIIGIIS |
| 241761090/61-405 | FKVILASIAFGVIARLFSESLANSAQWFKKVIPSAPLISFTGGLIVIALV |
| 255533420/59-389 | AYSVIAGLAFGLAAIAFVKLTEAFSHGFK.KISYPPLRPFAGGVLVLLLF |
| 256004137/57-387 | MKIIVLGVLFGLTGMLFSILLKKLRALLTNYIKNNIIRIFVFGTIIGIIS |
| 251796733/53-386 | IKVAAAAVLFGLSALLFVTLTHKLKAWFTKLLPNPMIKSFVGGLIIIALV |
| 125974665/60-390 | MKIIVLGVLFGLTGMLFSILLKKLRALLTNYIKNNIIRIFVFGTIIGIIS |
| 293374935/63-394 | YKVMACSILFGLMSKLFAELTHYLKKIFSDKLKKSYVKSFVGGLIIIGLM |
| 149197279/60-400 | FYTFLVAILFGWTAMLFSKANHFWSDLFSKKISYPPLRPFIGGIVLALAF |
| 260584530/57-386 | LKMVVLGIAFGLTGRLFSVSLAYLKKYWSNKIPSPTLRIFLLGIGVSILI |
| 159897555/58-389 | AILVGAGICFGLASSAFAIWTELVQTWSRRWLPNPILRAVAGGGLIVSIS |
| 108757317/55-387 | AKWLVFAVAVAVVAVVFVELMHRLKKLLEQRVQVLPLRMALGGLAVLLLW |
| 310817431/55-387 | AKWCVFAVAVAAVAVVFVEGTHRLKKLLEGRIPALPLRMAVGGLAVVGLW |
| 126645925/55-387 | LWIIPAGIAFGFSGRLFAQTTHFFTHQFSKWVSYPPLRPVIGGLVIAIIV |
| 115376569/2-329 | AKWCVFAVAVAAVAVVFVEGTHRLKKLLEGRIPALPLRMAVGGLAVVGLW |
| 153853007/62-402 | LKLAAMGLVFGIVGSLFALILRYLRLKFAFRFSSPVKKVLIMGSVVAILM |
| 189911881/62-391 | LVLFLLAIASGFVAKLFTWLLHSISKYSQTWIVYPPFRPFVGGIILVVFF |
| 183221808/62-391 | LVLFLLAIASGFVAKLFTWLLHSISKYSQTWIVYPPFRPFVGGIILVVFF |
| 146300126/58-389 | FYTILLGLLSGFAALLFSRSTHFWGSLFSKNIKYPPLRPVIGGVVLAVAI |
| 283779250/63-421 | LKIVIAAVAFGLMARLFAELTHRTSALLKRYVPWSLARPAIGAAVVLLLT |
| 289639619/53-382 | LVVVIAAMIFGVAGRLFAVAIRALKLFYARRVSHPIPRVLLGSAVLLVAM |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 296122614/61-407 | GLIILLGAVAGLVAKGFSEGLHLAGRWYAKLLPDPIRRIAVGSLVVVFVA |
| 241888810/58-377 | SKLFLVGVVFVFVGILFVLLQRKTKGLVALN.....TNIIWILLVVFILV |
| | ................................................. |
| | alignment positions 251-300 |
| 94994029/66-396 | M...IGHVG......RYSGLGTHL.........LAAAFSG..QTILTYDW |
| 217422654/69-400 | T...LLHAP......QYLGLGIPT.........IEAAFRA...PLPVYDF |
| 53722888/61-392 | T...LLHAP......QYLGLGIPT.........IEAAFRA...PLPVYDF |
| 167915998/61-392 | T...LLHAP......QYLGLGIPT.........IEAAFRA...PLPVYDF |
| 254208316/69-400 | T...LLHAP......QYLGLGIPT.........IEAAFRA...PLPVYDF |
| 254202983/69-400 | T...LLHAP......QYLGLGIPT.........IEAAFRA...PLPVYDF |
| 254177294/70-401 | T...LLHAP......QYLGLGIPT.........IEAAFRA...PLPVYDF |
| 124381362/70-401 | T...LLHAP......QYLGLGIPT.........IEAAFRA...PLPVYDF |
| 134278691/61-392 | T...LLHAP......QYLGLGIPT.........IEAAFRA...PLPVYDF |
| 53716487/61-392 | T...LLHAP......QYLGLGIPT.........IEAAFRA...PLPVYDF |
| 167002346/61-392 | T...LLHAP......QYLGLGIPT.........IEAAFRA...PLPVYDF |
| 126447166/61-392 | T...LLHAP......QYLGLGIPT.........IEAAFRA...PLPVYDF |
| 121597200/61-392 | T...LLHAP......QYLGLGIPT.........IEAAFRA...PLPVYDF |
| 126442778/69-400 | T...LLHAP......QYLGLGIPT.........IEAAFRA...PLPVYDF |
| 28896294/62-392 | M...IGRVG......RYSGLGTHL.........IAAAFSG..QTILTYDW |
| 21910009/62-392 | M...IGRVG......RYSGLGTHL.........IAAAFSG..QTILTYDW |
| 242313952/69-400 | T...LLHAP......QYLGLGIPT.........IEAAFRA...PLPVYDF |
| 126458603/69-400 | T...LLHAP......QYLGLGIPT.........IEAAFRA...PLPVYDF |
| 76818704/69-400 | T...LLHAP......QYLGLGIPT.........IEAAFRA...PLPVYDF |
| 254264654/69-400 | T...LLHAP......QYLGLGIPT.........IEAAFRA...PLPVYDF |
| 226195674/69-400 | T...LLHAP......QYLGLGIPT.........IEAAFRA...PLPVYDF |
| 237508459/69-400 | T...LLHAP......QYLGLGIPT.........IEAAFRA...PLPVYDF |
| 167724759/61-392 | T...LLHAP......QYLGLGIPT.........IEAAFRA...PLPVYDF |
| 254186015/61-392 | T...LLHAP......QYLGLGIPT.........IEAAFRA...PLPVYDF |
| 167829250/61-392 | T...LLHAP......QYLGLGIPT.........IEAAFRA...PLPVYDF |
| 254184798/61-392 | T...LLHAP......QYLGLGIPT.........IEAAFRA...PLPVYDF |
| 167850723/61-392 | T...LLHAP......QYLGLGIPT.........IEAAFRA...PLPVYDF |
| 167743705/61-392 | T...LLHAP......QYLGLGIPT.........IEAAFRA...PLPVYDF |
| 257141781/61-392 | T...LLHAP......QYLGLGIPT.........IEAAFRA...PLPVYDF |
| 167615218/61-392 | T...LLHAP......QYLGLGIPT.........IEAAFRA...PLPVYDF |
| 254194484/61-392 | T...LLHAP......QYLGLGIPT.........IEAAFRA...PLPVYDF |
| 167907659/61-392 | T...LLHAP......QYLGLGIPT.........IEAAFRA...PLPVYDF |
| 254301074/61-392 | T...LLHAP......QYLGLGIPT.........IEAAFRA...PLPVYDF |
| 167923842/61-392 | T...LLHAP......QYLGLGIPT.........IEAAFRA...PLPVYDF |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 167577039/61-392 | T...LLHAP......QYLGLGIPT.........IEAAFRA...PLPVYDF |
| 94990116/66-396 | M...IGHVG......RYSGLGTHL.........IAAAFSG..QTILTYDW |
| 83716137/69-400 | T...LLHAP......QYLGLGIPT.........IEAAFRA...PLPVYDF |
| 94988234/66-396 | M...IGHVG......RYSGLGTHL.........IAAAFSG..QTILTYDW |
| 71903194/66-396 | M...IGHVG......RYSGLGTHL.........IAAAFSG..QTILTYDW |
| 94992108/66-396 | M...IGHVG......RYSGLGTHL.........IAAAFSG..QTILTYDW |
| 306827662/62-392 | M...IGHVG......RYSGLGTHL.........IAAAFSG..QTILTYDW |
| 19745820/62-392 | M...IGHVG......RYSGLGTHL.........IAAAFSG..QTILTYDW |
| 139474077/62-392 | M...IGHVG......RYSGLGTHL.........IAAAFSG..QTILTYDW |
| 71910363/62-392 | M...IGHVG......RYSGLGTNL.........IAAAFSG..QTILTYDW |
| 50913916/66-396 | M...IGHVG......RYSGLGTHL.........LAAAFSG..QTILTYDW |
| 209559106/62-392 | M...IGHVG......RYSGLGTNL.........IAAAFSG..QTILTYDW |
| 15674779/62-392 | M...IGHVG......RYSGLGTNL.........IAAAFSG..QTILTYDW |
| 167566636/61-392 | T...LLQTP......QYLGLGIPT.........IEAAFRG...PLPVYDF |
| 167573712/61-392 | T...LLQTP......QYLGLGIPT.........IEAAFRG...PLPVYDF |
| 251782109/62-392 | M...IGHVG......RYSGLGTNL.........IAAAFSG..QTILTYDW |
| 66768521/61-392 | W...LLGTQ......RYIGLGIPE.........IVRAFHE...PMEPWDF |
| 21231425/61-392 | W...LLGTQ......RYIGLGIPE.........IVRAFHE...PMEPWDF |
| 188991670/81-412 | W...LLGTQ......RYIGLGIPE.........IVRAFHE...PMEPWDF |
| 221210981/61-392 | T...ALNVP......QYLGLGIPT.........IEAAFRG...PLPVYDF |
| 189352355/61-392 | T...ALNVP......QYLGLGIPT.........IEAAFRG...PLPVYDF |
| 161521476/61-392 | T...ALNVP......QYLGLGIPT.........IEAAFRG...PLPVYDF |
| 221203824/61-392 | T...ALNVP......QYLGLGIPT.........IEAAFRG...PLPVYDF |
| 221197152/61-392 | T...ALNVP......QYLGLGIPT.........IEAAFRG...PLPVYDF |
| 77408502/58-387 | F...IFHFG......RYSGLGTNL.........IEASFTN..KNLYDYDW |
| 167583829/60-391 | T...ALNVP......RYLGLGIPT.........IEAAFHG...PLPAYDF |
| 77411121/58-387 | F...IFHFG......RYSGLGTNL.........IEASFTN..KNLYDYDW |
| 76798380/58-387 | F...IFHFG......RYSGLGTNL.........IEASFTN..KNLYDYDW |
| 76787827/58-387 | F...IFHFG......RYSGLGTNL.........IEASFTN..KNLYDYDW |
| 25010655/58-387 | F...IFHFG......RYSGLGTNL.........IEASFTN..KNLYDYDW |
| 22536719/58-387 | F...IFHFG......RYSGLGTNL.........IEASFTN..KNLYDYDW |
| 170701178/116-447 | T...VLNVP......QYLGLGIPT.........IEAAFHG...PLPAYDF |
| 134292888/61-392 | T...VLNVP......QYLGLGIPT.........IEAAFHG...PLPAYDF |
| 115360262/61-392 | T...VLNVP......QYLGLGIPT.........IEAAFHG...PLPAYDF |
| 172062717/116-447 | T...VLNVP......QYLGLGIPT.........IEAAFHG...PLPAYDF |
| 170736113/61-392 | T...MLNVP......QYLGLGIPT.........IEAAFHG...PLPLYDF |
| 254248860/130-461 | T...VLNVP......QYLGLGIPT.........IEAAFHG...PLPLYDF |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 206562684/116-447 | T...VLNVP......QYLGLGIPT.........IEAAFHG...PLPLYDF |
| 116691890/61-392 | T...VLNVP......QYLGLGIPT.........IEAAFHG...PLPLYDF |
| 107026913/61-392 | T...VLNVP......QYLGLGIPT.........IEAAFHG...PLPLYDF |
| 78063149/61-392 | T...ALNVP......QYLGLGIPT.........IEAAFHG...PLPLYDF |
| 224824608/61-392 | Y...LLGAD......RYIGLGVPT.........IVEAFQQ...PLAPYDF |
| 300697592/50-381 | M...ALGTD......RYLGLGIPT.........IVEAFHN...PLPAYDF |
| 187925675/61-392 | T...VLNVP......QYLGLGIPT.........IVESFNQ...SLPVYDF |
| 160897178/61-392 | W...ALDAY......RYIGLGIPD.........IARSFQE...PMLPWDF |
| 207739311/50-381 | M...ALGTD......RYLGLGIPT.........IVEAFHN...PLPAYDF |
| 300311782/61-392 | W...AVGTH......RYIGLGIPV.........IVEAFQQ...PLAPWDF |
| 83748726/62-393 | M...ALGTD......RYLGLGIPT.........IVEAFHN...PLPAYDF |
| 17546522/50-381 | T...ALGTD......KYLGLGIPV.........IVDAFHQ...PLPAYDF |
| 207724636/50-381 | M...ALGTD......RYLGLGIPT.........IVEAFHN...PLPAYDF |
| 166712100/61-392 | W...GLGTQ......RYIGLGIPA.........IVRAFHE...PMAPWDF |
| 84624054/61-392 | W...GLGTQ......RYIGLGIPE.........IVRAFHE...PMAPWDF |
| 58582162/61-392 | W...GLGTQ......RYIGLGIPE.........IVRAFHE...PMAPWDF |
| 188576912/61-392 | W...GLGTQ......RYIGLGIPE.........IVRAFHE...PMAPWDF |
| 188576721/61-392 | W...GLGTQ......RYIGLGIPE.........IVRAFHE...PMAPWDF |
| 237728386/61-392 | W...FIGTD......RYIGLGIPE.........IVRAFKE...PLYPMDF |
| 34497884/61-392 | S...LMDAR......AYLGLGIPT.........LVSAFQQ...PLSPYDV |
| 285018239/61-392 | W...ILDAY......HYVGLGIPD.........IVRSFQQ...PLPSWDF |
| 66044733/61-398 | W...ALGSNHYIDVDKYIGLGIPS.........IVQSFQM...PMAPWDW |
| 213971827/61-398 | W...ALGSNHYIDVDKYIGLGIPS.........IVQSFQM...PMAPWDW |
| 171058747/61-392 | W...FGDGW......RYAGLGIPV.........IVEAFVQ...PVPSWDF |
| 238025034/95-426 | G...ALAVP......QYLGLGIPT.........IEAAFRG...PLPVYEF |
| 229589423/61-398 | W...ALGSNHYTDVDKYIGLGIPS.........IVQSFQM...PMAPWDW |
| 300693842/50-381 | M...ALGTD......KYLGLGIQT.........IVDAFHH...PLPAYDF |
| 28871751/65-402 | W...ALGSNHYIDVDKYIGLGIPS.........IVQSFQM...PMAPWDW |
| 237801960/61-398 | W...ALGSNHYIDVDKYIGLGIPS.........IVQSFQM...PMAPWDW |
| 241665656/62-393 | L...ALGTD......KYLGLGIPV.........IVDTFHN...PLPAYDF |
| 187926168/62-393 | L...ALGTD......KYLGLGIPV.........IVDTFHN...PLPAYDF |
| 302059036/73-410 | W...ALGSNHYIDVDKYIGLGIPS.........IVQSFQM...PMAPWDW |
| 309779037/62-393 | L...ALGTD......KYLGLGIPV.........IVDAFHT...PLPAYDF |
| 126698234/62-390 | L...LFYKG......RYSGLGTNL.........IQNSFYG..GEIYSFDW |
| 306519283/74-402 | L...LFYKG......RYSGLGTNL.........IQNSFYG..GEIYSFDW |
| 260685949/74-402 | L...LFYKG......RYSGLGTNL.........IQNSFYG..GEIYSFDW |
| 260682350/74-402 | L...LFYKG......RYSGLGTNL.........IQNSFYG..GEIYSFDW |

TABLE 6-continued

Sequences and alignments of examples of fluoride transporters. The first column lists the GI number for the protein in the NCBI RefSeq database and, following the slash, the amino acids positions of the protein that are aligned in the table.

| | | | |
|---|---|---|---|
| 255649173/74-402 | L...LFYKG......RYSGLGTNL.........IQNSFYG..GEIYSFDW |
| 255516076/74-402 | L...LFYKG......RYSGLGTNL.........IQNSFYG..GEIYSFDW |
| 255313389/74-402 | L...LFYKG......RYSGLGTNL.........IQNSFYG..GEIYSFDW |
| 255091661/74-402 | L...LFYKG......RYSGLGTNL.........IQNSFYG..GEIYSFDW |
| 254974264/74-402 | L...LFYKG......RYSGLGTNL.........IQNSFYG..GEIYSFDW |
| 225868779/61-391 | L...LCHYG......RYSGLGTNL.........ITAAFSH..QPIANYDW |
| 255099763/74-402 | L...LFYKG......RYSGLGTNL.........IQNSFYG..GEIYSFDW |
| 255305648/74-402 | L...LFYKG......RYSGLGTNL.........IQNSFYG..GEIYSFDW |
| 225870265/61-391 | L...LCHYG......RYSGLGTNL.........ITAAFSH..QPIANYDW |
| 296878238/74-402 | L...LFDKG......RYSGLGTNL.........IQNSFYG..GEIYSFDW |
| 296449441/74-402 | L...LFDKG......RYSGLGTNL.........IQNSFYG..GEIYSFDW |
| 255654699/74-402 | L...LFDKG......RYSGLGTNL.........IQNSFYG..GEIYSFDW |
| 296876619/58-390 | LNLQLTKVG......TYSGLGTNL.........IDVAFHQ..GSAQSYDW |
| 163790421/57-388 | L...IFQMG......RYSGLGTNL.........IAASFSG..GSIYGYDW |
| 24379705/63-392 | L...VLYQG......RYSGLGTNL.........ISASFSD..GKIYVYDW |
| 290580296/63-392 | L...VLYQG......RYSGLGTNL.........ISASFSD..EKIYVYDW |
| 171780017/63-391 | L...MLYHG......RYSGLGTNL.........IDASFSG..KVIYFYDW |
| 261407611/66-398 | Y...LLGTR......DYLGLGIPL.........IEAAFAG...EVSPFAF |
| 299137255/65-396 | F...ALGTT......KYIGLGIPT.........IVASFDH...KLPAYDW |
| 237668509/58-389 | I...VMHTG......RYSGLGTNL.........ISSSFNG..SSIYNYDW |
| 182416531/58-389 | I...VMHTG......RYSGLGTNL.........ISSSFNG..SSIYNYDW |
| 288905673/63-391 | L...ICYHG......RYSGLGTNL.........IEASFAG..KEIYLYDW |
| 306831767/63-391 | L...ICYHG......RYSGLGTNL.........IEASFAG..KEIYLYDW |
| 125624281/58-389 | L...VIHMD......RYAGLGTNL.........IGLSFNG..GHINGYDW |
| 306833893/72-400 | L...ICYHG......RYSGLGTNL.........IEASFAG..KEIYFYDW |
| 24379706/63-391 | T...AAGMG......RYSGLSTDL.........VTASFAK..GTVYPFDW |
| 223936158/62-409 | Y...LVGTR......DYLGLGITSPDP..KAVTILSAFHP..DGAHVLSW |
| 168216344/69-400 | Y...LIGSR......KYLGLSLPL.........LSEAFNR...HVSPFDF |
| 281491597/58-389 | L...VIHLD......RYAGLGTNL.........ISLSFNG..GHINGYDW |
| 116627914/63-392 | L...ILCKG......RYTGLGTNL.........IALSVDG..GTIYPLDW |
| 290580295/63-391 | T...AAGMG......RYSGLSTDL.........VTASFAK..GTVFPFDW |
| 15673080/58-389 | L...VIHLD......RYAGLGTNL.........ISLSFNG..GHINGYDW |
| 116511937/58-389 | L...VIHMD......RYAGLGTNL.........IGLSFNG..GHINGYDW |
| 257874163/61-390 | V...LLYQG......RYSGLGTNL.........ISASFTN..QPIYSYDW |
| 257867835/61-390 | V...LLYQG......RYSGLGTNL.........ISASFTN..QPIYSYDW |
| 55821189/63-392 | L...ILCKG......RYTGLGTNL.........IALSVDG..GTIYPLDW |
| 182626550/69-400 | Y...LIGSR......KYLGLSLPL.........LSEAFDG...HVSPFDF |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 110803970/69-400 | Y...LVGSR......KYLGLSLPL.........LSEAFNG...HISPFDF |
| 55823099/63-392 | L...ILCKG......RYTGLGTNL.........IALSVDG..GTIYPLDW |
| 209544766/77-424 | F...LAGSR......DYLGLGITAPEP..GGASILDFFGP...AHYAWSW |
| 169343074/69-400 | Y...LIGSR......KYLGLSLPL.........LSEAFNG...HVSPFDF |
| 110800437/69-400 | Y...LVGSR......KYLGLSLPL.........LSEAFDG...HVSPFDF |
| 168210325/69-400 | Y...LVGSR......KYLGLSLPL.........LSEAFDG...HVSPFDF |
| 253755995/54-382 | F...FFHQG......RYTGLGTNL.........IDASLAG..EQVFAFDW |
| 253754061/54-382 | F...FFHQG......RYTGLGTNL.........IDASLAG..EQVFAFDW |
| 253752235/54-382 | F...FFHQG......RYTGLGTNL.........IDASLAG..EQVFAFDW |
| 146321395/54-382 | F...FFHQG......RYTGLGTNL.........IDASLAG..EQVFAFDW |
| 146319191/54-382 | F...FFHQG......RYTGLGTNL.........IDASLAG..EQVFAFDW |
| 256423027/87-434 | Y...LLGTR......DYIGLGVTTPDP..NGVSIVNAFTT..KEISSWGW |
| 168207393/69-400 | Y...LIGSR......KYLGLSLPL.........LSEAFDG...HVSPFDF |
| 168214512/69-400 | Y...LVGSR......KYLGLSLPL.........LSEAFNG...HVSPFDF |
| 18309572/69-400 | Y...LVGSR......KYLGLSLPL.........LSEAFNG...HVSPFDF |
| 162149525/77-424 | F...LAGSR......DYLGLGITAPEP..GGASILDFFGP...AHYAWSW |
| 196229369/63-411 | F...LVGTS......DYLGLGVSSPDP..RAVTIVSFFQS..PEIHYWSW |
| 257876728/61-390 | V...LLYQG......RYSGLGTNL.........ISASFTK..QPIYSYDW |
| 251797520/69-399 | Y...LLGTR......EYLGLGIPL.........LQDSFEY...PVAPLAF |
| 195977885/1-309 | L...LCHYG......RYSGLGTNL.........ITSAFSH..QTITNYDW |
| 222152807/62-391 | F...LFYQG......RYSGLGTNL.........IQLSFTN..HAIKSYDW |
| 59710638/60-408 | Q...LLGNY......DYIGIGVYPSRD..GGVSITSAFTE..GGAEWYSW |
| 167766061/56-388 | F...IIHGS......RYSGLGTNI.........ISAGFAG..QTIYSYDW |
| 228476400/63-392 | L...ILWKG......RYTGLGTNL.........IALSVGG..GTIYPLDW |
| 197334244/60-408 | Q...LLGNY......DYIGIGVYPSRD..GGVSITSAFTE..GGAEWYSW |
| 284005894/64-409 | W...LVGTR......DYLGLGVVSQQP..NGISILNAFHS..GGITPWSW |
| 95928333/62-409 | F...LLGTR......DYLGLGVGSASG..DGISIVNAFSG..VGVTPWSW |
| 307277103/61-391 | L...VLKNQ......RYLGLSLPL.........LEDAFAG...NAQPFDF |
| 171911999/62-407 | L...LTGTR......DFLGLGVHAPPG..GAVSILSSFEP..GGASGWSW |
| 257421896/61-391 | L...VLNNQ......RYLGLSLPL.........LEDAFAG...NAQPFDF |
| 300779490/57-408 | F...INGKP......DYLSLGVDPEYQ..GAVTIQSAFHA..GGSDPWSW |
| 257416700/61-391 | L...VLNNQ......RYLGLSLPL.........LEDAFAG...NAQPFDF |
| 307271571/61-391 | L...VLNNQ......RYLGLSLPL.........LEDAFAG...NAQPFDF |
| 300860446/61-391 | L...VLNNQ......RYLGLSLPL.........LEDAFAG...NAQPFDF |
| 257419916/61-391 | L...VLNNQ......RYLGLSLPL.........LEDAFAG...NAQPFDF |
| 256963630/61-391 | L...VLNNQ......RYLGLSLPL.........LEDAFAG...NAQPFDF |
| 256956740/61-391 | L...VLNNQ......RYLGLSLPL.........LEDAFAG...NAQPFDF |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 255972070/61-391 | L...VLNNQ......RYLGLSLPL.........LEDAFAG...NAQPFDF |
| 229549364/61-391 | L...VLNNQ......RYLGLSLPL.........LEDAFAG...NAQPFDF |
| 149280114/62-411 | Y...AIGKP......DYLSLGVDSEYQ..GAVTIPSAFQP..GGADTWSW |
| 307290483/61-391 | V...VLNNQ......RYLGLSLPL.........LEDAFAG...NAQPFDF |
| 256853823/61-391 | V...VLNNQ......RYLGLSLPL.........LEDAFAG...NAQPFDF |
| 256616980/61-391 | L...VLKNQ......RYLGLSLPL.........LEDAFAG...NAQPFDF |
| 229545116/61-391 | L...VLNNQ......RYLGLSLPL.........LEDAFAG...NAQPFDF |
| 257081959/61-391 | L...VLNNQ......RYLGLSLPL.........LEDAFTG...NAQPFDF |
| 307285753/61-391 | L...VSNNQ......RYLGLSLPL.........LEDAFAG...NAQPFDF |
| 255975137/61-391 | L...VSNNQ......RYLGLSLPL.........LEDAFAG...NAQPFDF |
| 257090652/61-391 | L...VLNNQ......RYLGLSLPL.........LEDAFAG...NAQPFDF |
| 256763156/61-391 | L...VLNNQ......RYLGLSLPL.........LEDAFAG...NAQPFDF |
| 29376957/61-391 | L...VLNNQ......RYLGLSLPL.........LEDAFAG...NAQPFDF |
| 227553996/61-391 | L...VLNNQ......RYLGLSLPL.........LEDAFAG...NAQPFDF |
| 307287657/61-391 | L...VLNNQ......RYLGLSLPL.........LEDAFAG...NAQPFDF |
| 293387361/61-391 | L...VLNNQ......RYLGLSLPL.........LEDAFAG...NAQPFDF |
| 293383526/61-391 | L...VLNNQ......RYLGLSLPL.........LEDAFAG...NAQPFDF |
| 256961242/61-391 | L...VLNNQ......RYLGLSLPL.........LEDAFAG...NAQPFDF |
| 300731132/63-397 | F...GLGTSH...TLKYIGLGIPT.........IVAAFHS...RLPAYDF |
| 257087493/61-391 | L...VLNNQ......RYLGLSLPL.........LEDAFAG...NAQPFDF |
| 307270777/61-391 | L...VLNNQ......RYLGLSLPL.........LEDAFAG...NAQPFDF |
| 294780852/61-391 | L...VLNNQ......RYLGLSLPL.........LEDAFAG...NAQPFDF |
| 257079694/61-391 | L...VLNNQ......RYLGLSLPL.........LEDAFAG...NAQPFDF |
| 222086761/62-408 | Y...ALGTR......EYLGLGVWSPNP..GDATIPGFFDP..ARVDYWGW |
| 257084511/61-391 | L...VLNNQ......RYLGLSLPL.........LEDAFAG...NAQPFDF |
| 240137886/73-417 | Y...ALGTR......DYLGLGVSAAEP..GGLTITGFFGP...DIHPWSW |
| 302024216/54-382 | F...FFHQG......HYTGLGTNL.........IDASLAG...EQVFAFDW |
| 222147858/69-416 | W...LLGTR......DYLGLGVWSPHP..GDVTILSFFRP..DHVDAWSW |
| 293559774/61-391 | L...ILQTQ......RYLGLSLPL.........LQESFNG...QAHAYDF |
| 260558935/61-391 | L...ILQTQ......RYLGLSLPL.........LQESFNG...QAHAYDF |
| 257890482/61-391 | L...ILQTQ......RYLGLSLPL.........LQESFNG...QAHAYDF |
| 154484719/61-393 | L...LLWQG......RYSGLGTNL.........ILNAFNN..GEIFLADW |
| 227519818/61-391 | L...ILNNQ......RYLGLSLPL.........LEDAFAG...NAQPFDF |
| 86143630/67-398 | Y...LIGTT......KYIGLGVPT.........IVDSFSE...AMNKYDF |
| 293568623/61-391 | L...ILQTQ......RYLGLSLPL.........LQESFNG...QAHAYDF |
| 251778279/66-397 | Y...LIGTR......DYLGLSLPL.........INNSFTQ...NVSPFAF |
| 257886896/61-391 | L...ILQTQ......RYLGLSLPL.........LQESFNG...QAHAYDF |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 188588504/66-397 | Y...LIGTR......DYLGLSLPL.........INNSFTE...NVSPFAF |
| 293571654/61-391 | L...ILQTQ......RYLGLSLPL.........LQESFNG...QAHAYDF |
| 300863903/61-393 | W...AMGSS......KYIGLGIPT.........IVDAFYS...QLPPWDF |
| 257895467/61-391 | L...ILQTQ......RYLGLSLPL.........LQESFNG...QAHAYDF |
| 257898081/61-391 | L...ILQTQ......RYLGLSLPL.........LQESFNE...QAHAYDF |
| 69249390/61-391 | L...ILQTQ......RYLGLSLPL.........LQESFNG...QAHVYDF |
| 258614354/61-391 | L...ILQTQ......RYLGLSLPL.........LQESFNG...QAHVYDF |
| 257893085/61-391 | L...ILQTQ......RYLGLSLPL.........LQESFNG...QAHVYDF |
| 257879974/61-391 | L...ILQTQ......RYLGLSLPL.........LQESFNG...QAHVYDF |
| 294053809/63-411 | Y...CLGTW......DYLGLGVYSSQE..GGVSIVNAFEA...GGATSFSW |
| 149275805/8-356 | S...LLGKP......DYLGLGVESEYP..GAVTIPAAFQI...GGADTWSW |
| 293553829/61-391 | L...ILQTQ......RYLGLSLPL.........LQESFNG...QAHVYDF |
| 224023708/79-410 | W...LLGTT......KYIGLGVPV.........IVASFTE...QQMWYDF |
| 294623042/61-391 | L...ILQTQ......RYLGLSLPL.........LQESFNG...QAHVYDF |
| 289567585/61-391 | L...ILQTQ......RYLGLSLPL.........LQESFNG...QAHVYDF |
| 261209457/61-391 | L...ILQTQ......RYLGLSLPL.........LQESFNG...QAHVYDF |
| 257884112/61-391 | L...ILQTQ......RYLGLSLPL.........LQESFNG...QAHVYDF |
| 189460046/67-398 | W...LLGTT......KYIGLGVPT.........IVASFSE...QQMWYDF |
| 294620207/61-391 | L...ILQTQ......RYLGLSLPL.........LQESFNG...QAHVYDF |
| 118579274/62-407 | Y...LLGTR......DYLGLGVSSPDP..QAVTIISCFSA...NGATPWSW |
| 58040573/61-408 | M...IVGNR......DYLGLGVLPAEP..GGASIVSFFGP...TIYPWSW |
| 187932697/74-404 | Y...LIGTR......DYLGLSLPL.........INNSFTE...QVSPFAF |
| 293378332/61-391 | L...ILQTQ......RYLGLSLPL.........LQESFNG...QAHAYDF |
| 296115670/62-409 | Y...LVGSR......DYLGLGVVSMGH..DAPSIVNFFHA...GDYTWSW |
| 227551941/85-415 | L...ILQTQ......RYLGLSLPL.........LQESFNG...QAHAYDF |
| 294616356/61-391 | L...ILQTQ......RYLGLSLPL.........LQESFNG...QAHVYDF |
| 257883083/61-391 | L...ILQTQ......RYLGLSLPL.........LQESFNG...QAHVYDF |
| 253771312/60-391 | L...IIGDY......KYLGLSLPL.........MENAFKG...HVHPMDF |
| 225166826/60-391 | L...IIGDY......KYLGLSLPL.........MENAFKG...HVHPMDF |
| 307688608/69-400 | L...LIGTR......EYLGLGLPY.........ISASFNE...GVPKLAF |
| 302873225/69-400 | L...LIGTR......EYLGLGLPY.........ISASFNE...GVPKLAF |
| 87306694/62-420 | W...LLGTR......DYLGLGVTPHPPDSGMICIESCFQP..GGADWMSW |
| 88801314/65-397 | Y...LMGTT......KYIGLGIPT.........IVDAFNI...DLNSHDF |
| 218283679/62-391 | F...VFGKC......RYSGVGENL.........IVGSFTS...EKIYSYDW |
| 240146274/81-413 | F...LLYNG......RYSGLGTNL.........ISAAFSG...GMIYSYDW |
| 197301848/54-386 | F...LFHGG......RYSGLGTNL.........ISAAFEN...GTIYGYDW |
| 198275782/67-397 | W...MMGTT......KYIGLGVPT.........IVASFSE...QQMWYDF |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 304404790/58-390 | Y...AAGTR......QYIGLGLPL.........IAQSFHE...AASPLAF |
| 227540545/49-380 | W...CIGTT......AYIGLGIPG.........IEASFQQ...TAQPYDF |
| 260771568/62-409 | K...LIGNY......DYIGIGVYPIRE..GGVSITSAFEA..GGAEWNSW |
| 307818395/70-401 | F...TMGTT......RYIGLGVPV.........IVDAFHH...VLPRADF |
| 300771325/49-380 | W...CIGTT......AYIGLGIPG.........IEASFQQ...TAQPYDF |
| 283796370/78-411 | L...LFYGG......RYCGLGTNL.........IEGSLSG..EDVKVFDW |
| 300778780/74-405 | F...AMGTT......RYIGLGIPM.........IMESFEK...QLPLYDF |
| 283856276/78-422 | Y...ITGTR......DYLGIGTIAAQP..NGLQLGSFFDA..QQHHYWSW |
| 260752944/61-405 | Y...ITGTR......DYLGIGTIAAQP..NGLQLGSFFDP..QQHHYWSW |
| 281418863/57-387 | I...ICFQG......RYSGPGTNL.........ISACFSN...DIMPWDF |
| 241761090/61-405 | Y...ITGTR......DYLGIGTIAAQP..NGLQLGSFFDP..QQHHYWSW |
| 255533420/59-389 | L...LPGTY......KFAGLGIPA.........ILDSFNT...ASQGSDF |
| 256004137/57-387 | I...ICFQG......RYSGPGTNL.........ISACFSN...DIMPWDF |
| 251796733/53-386 | Y...LIGSR......NYLGLGLPL.........LQHSFEE...AAAPLAF |
| 125974665/60-390 | I...ICFQG......RYSGPGTNL.........ISACFSN...DIMPWDF |
| 293374935/63-394 | L...MIRNR......MYLGLSLPL.........LKEAFES...PVVGYAF |
| 149197279/60-400 | W...ALGQTSV.DFTKYVGLGVPV.........IEESFTQ...RMMPYDF |
| 260584530/57-386 | A...AFGSG......RYAGLGTNL.........IHASFYS...ETIFVQDW |
| 159897555/58-389 | F...LLNTR......DYNGLSLPL.........LAQAFEP...RGVVFWAF |
| 108757317/55-387 | L...LAGTD......DYLGLGVPG.........IQRAFED..PALPVSAF |
| 310817431/55-387 | K...LVGTD......MYLGLGVPT.........LVRAFVD..PALPESAF |
| 126645925/55-387 | W...FSDST......TYIGLGVPR.........IVEAFEQ...PLPWYDW |
| 115376569/2-329 | K...LVGTD......MYLGLGVPT.........LVRAFVD..PALPESAF |
| 153853007/62-402 | M...IFHQG......RYSGTGSNL.........VALCFDGITDDIYAYDW |
| 189911881/62-391 | L...SGVHL......DYFGLGVKT.........IQNAFTG...FLPYESF |
| 183221808/62-391 | L...SGVHL......DYFGLGVKT.........IQNAFTG...FLPYESF |
| 146300126/58-389 | A...GLGFT......KFSGLGVPV.........IVDSFSN...PSEWYDF |
| 283779250/63-421 | A...IVASR......DYLGLGVMPDPHDPSLMTIAGCFEE..GGAGPMSW |
| 289639619/53-382 | L...ALRAV......PYAGLSTWM.........IGAGFAG...KAQWYDG |
| 296122614/61-407 | E...FVVGR......DYLGLGTTNLNP..HAVTIGSCFRA..GGAHDWSW |
| 241888810/58-377 | N...IVFDY......RYASLGTNL.........IDFSFTD.FEQIQVYDF |
| | ................................................ |
| | alignment positions 301-350 |
| 94994029/66-396 | LLKMIVTVISLSAGFQGGEVTPLFAIGASLG....IVLAPYLG.LPVLLV |
| 217422654/69-400 | AGKFAFTVVTLASGFKGGEVTPLFYIGATLG....NALSPLLA.LPAPVL |
| 53722888/61-392 | AGKFAFTVVTLASGFKGGEVTPLFYIGATLG....NALSPLLA.LPAPVL |
| 167915998/61-392 | AGKFAFTVVTLASGFKGGEVTPLFYIGATLG....NALSPLLA.LPAPVL |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 254208316/69-400 | AGKFAFTVVTLASGFKGGEVTPLFYIGATLG....NALSPLLA.LPAPVL |
| 254202983/69-400 | AGKFAFTVVTLASGFKGGEVTPLFYIGATLG....NALSPLLA.LPAPVL |
| 254177294/70-401 | AGKFAFTVVTLASGFKGGEVTPLFYIGATLG....NALSPLLA.LPAPVL |
| 124381362/70-401 | AGKFAFTVVTLASGFKGGEVTPLFYIGATLG....NALSPLLA.LPAPVL |
| 134278691/61-392 | AGKFAFTVVTLASGFKGGEVTPLFYIGATLG....NALSPLLA.LPAPVL |
| 53716487/61-392 | AGKFAFTVVTLASGFKGGEVTPLFYIGATLG....NALSPLLA.LPAPVL |
| 167002346/61-392 | AGKFAFTVVTLASGFKGGEVTPLFYIGATLG....NALSPLLA.LPAPVL |
| 126447166/61-392 | AGKFAFTVVTLASGFKGGEVTPLFYIGATLG....NALSPLLA.LPAPVL |
| 121597200/61-392 | AGKFAFTVVTLASGFKGGEVTPLFYIGATLG....NALSPLLA.LPAPVL |
| 126442778/69-400 | AGKFAFTVVTLASGFKGGEVTPLFYIGATLG....NALSPLLA.LPAPVL |
| 28896294/62-392 | LLKMIVTVISLSAGFQGGEVTPLFAIGASLG....IVLAPYLG.LPVLLV |
| 21910009/62-392 | LLKMIVTVISLSAGFQGGEVTPLFAIGASLG....IVLAPYLG.LPVLLV |
| 242313952/69-400 | AGKFAFTVVTLASGFKGGEVTPLFYIGATLG....NALSSLLA.LPAPVL |
| 126458603/69-400 | AGKFAFTVVTLASGFKGGEVTPLFYIGATLG....NALSSLLA.LPAPVL |
| 76818704/69-400 | AGKFAFTVVTLASGFKGGEVTPLFYIGATLG....NALSSLLA.LPAPVL |
| 254264654/69-400 | AGKFAFTVVTLASGFKGGEVTPLFYIGATLG....NALSSLLA.LPAPVL |
| 226195674/69-400 | AGKFAFTVVTLASGFKGGEVTPLFYIGATLG....NALSSLLA.LPAPVL |
| 237508459/69-400 | AGKFAFTVVTLASGFKGGEVTPLFYIGATLG....NALSSLLA.LPAPVL |
| 167724759/61-392 | AGKFAFTVVTLASGFKGGEVTPLFYIGATLG....NALSSLLA.LPAPVL |
| 254186015/61-392 | AGKFAFTVVTLASGFKGGEVTPLFYIGATLG....NALSSLLA.LPAPVL |
| 167829250/61-392 | AGKFAFTVVTLASGFKGGEVTPLFYIGATLG....NALSSLLA.LPAPVL |
| 254184798/61-392 | AGKFAFTVVTLASGFKGGEVTPLFYIGATLG....NALSSLLA.LPAPVL |
| 167850723/61-392 | AGKFAFTVVTLASGFKGGEVTPLFYIGATLG....NALSSLLA.LPAPVL |
| 167743705/61-392 | AGKFAFTVVTLASGFKGGEVTPLFYIGATLG....NALSSLLA.LPAPVL |
| 257141781/61-392 | AGKFAFTVVTLASGFKGGEVTPLFYIGATLG....NALSHLLA.LPVPVL |
| 167615218/61-392 | AGKFAFTVVTLASGFKGGEVTPLFYIGATLG....NALSHLLA.LPVPVL |
| 254194484/61-392 | AGKFAFTVVTLASGFKGGEVTPLFYIGATLG....NALSSLLA.LPAPVL |
| 167907659/61-392 | AGKFAFTVVTLASGFKGGEVTPLFYIGATLG....NALSSLLA.LPAPVL |
| 254301074/61-392 | AGKFAFTVVTLASGFKGGEVTPLFYIGATLG....NALSSLLA.LPAPVL |
| 167923842/61-392 | AGKFAFTVVTLASGFKGGEVTPLFYIGATLG....NALSSLLA.LPAPVL |
| 167577039/61-392 | AGKFAFTVVTLASGFKGGEVTPLFYIGATLG....NALSHLLA.LPVPVL |
| 94990116/66-396 | LLKMIVTVISLSAGFQGGEVTPLFAIGASLG....IVLAPYLG.LPVLLV |
| 83716137/69-400 | AGKFAFTVVTLASGFKGGEVTPLFYIGATLG....NALSHLLA.LPVPVL |
| 94988234/66-396 | LLKMIVTVISLSAGFQGGEVTPLFAIGASLG....IVLAPYLG.LPVLLV |
| 71903194/66-396 | LLKMIVTVISLSAGFQGGEVTPLFAIGASLG....IVLAPYLG.LPVLLV |
| 94992108/66-396 | LLKMIVTVISLSAGFQGGEVTPLFAIGASLG....IVLAPYLG.LPVLLV |
| 306827662/62-392 | LLKMIVTVISLSAGFQGGEVTPLFTIGASLG....IILAPYLG.LPVLLV |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 19745820/62-392 | LLKMIVTVISLSAGFQGGEVTPLFTIGASLG....IILAPYLG.LPVLLV |
| 139474077/62-392 | LLKMIVTVISLSAGFQGGEVTPLFTIGASLG....IILAPYLG.LPVLLV |
| 71910363/62-392 | LLKMIVTVISLSAGFQGGEVTPLFAIGASLG....IVLAPYLG.LPVLLV |
| 50913916/66-396 | LLKMIVTVISLSAGFQGGEVTPLFAIGASLG....IVLAPYLG.LPVLLV |
| 209559106/62-392 | LLKMIVTVISLSAGFQGGEVTPLFAIGASLG....IVLAPYLG.LPVLLV |
| 15674779/62-392 | LLKMIVTVISLSAGFQGGEVTPLFAIGASLG....IVLAPYLG.LPVLLV |
| 167566636/61-392 | AGKFAFTVVTLASGFKGGEVTPLFYIGTTLG....NALSHLLA.LPVPVL |
| 167573712/61-392 | AGKFAFTVVTLASGFKGGEVTPLFYIGATLG....NALSHLLA.LPVPVL |
| 251782109/62-392 | LLKMIVTVISLSAGFQGGEVTPLFAIGASLG....LVLAPYLG.LPVLLV |
| 66768521/61-392 | LGKACFTVASLATGFKGGEVTPLFYIGATLG....NALAPLLQ.LPFSML |
| 21231425/61-392 | LGKACFTVASLATGFKGGEVTPLFYIGATLG....NALAPLLQ.LPFSML |
| 188991670/81-412 | LGKACFTVASLATGFKGGEVTPLFYIGATLG....NALAPLLQ.LPFSML |
| 221210981/61-392 | AGKFAFTVVTLASGFKGGEVTPLFYIGATLG....NALGQVLA.LPVPVL |
| 189352355/61-392 | AGKFAFTVVTLASGFKGGEVTPLFYIGATLG....NALGQVLA.LPVPVL |
| 161521476/61-392 | AGKFAFTVVTLASGFKGGEVTPLFYIGATLG....NALGQVLA.LPVPVL |
| 221203824/61-392 | AGKFAFTVVTLASGFKGGEVTPLFYIGATLG....NALGHVLA.LPVPVL |
| 221197152/61-392 | AGKFAFTVVTLASGFKGGEVTPLFYIGATLG....NALGHVLA.LPVPVL |
| 77408502/58-387 | LLKLCLTVITLAAGYQGGEVTPLFAIGASLG....VIIAPILG.LPVILV |
| 167583829/60-391 | AGKFAFTVVTLASGFKGGEVTPLFYIGATLG....NALGQVLA.LPVPVL |
| 77411121/58-387 | LLKLCLTVITLAAGYQGGEVTPLFAIGASLG....VIIAPILG.LPVILV |
| 76798380/58-387 | LLKLCLTVITLAAGYQGGEVTPLFAIGASLG....VIIAPILG.LPVILV |
| 76787827/58-387 | LLKLCLTVITLAAGYQGGEVTPLFAIGASLG....VIIAPILG.LPVILV |
| 25010655/58-387 | LLKLCLTVITLAAGYQGGEVTPLFAIGASLG....VIIAPILG.LPVILV |
| 22536719/58-387 | LLKLCLTVITLAAGYQGGEVTPLFAIGASLG....VIIAPILG.LPVILV |
| 170701178/116-447 | AGKFAFTVVTLASGFKGGEVTPLFYIGATLG....NALGQVLA.LPMPVL |
| 134292888/61-392 | AGKFAFTVVTLASGFKGGEVTPLFYIGATLG....NALGQVLA.LPVPVL |
| 115360262/61-392 | AGKFAFTVVTLASGFKGGEVTPLFYIGATLG....NALGQVLA.LPVPVL |
| 172062717/116-447 | AGKFAFTVVTLASGFKGGEVTPLFYIGATLG....NALGQVLA.LPVPVL |
| 170736113/61-392 | AGKFAFTVVTLASGFKGGEVTPLFYIGATLG....NALGQVLA.LPVPVL |
| 254248860/130-461 | AGKFAFTVVTLASGFKGGEVTPLFYIGATLG....NALGQVLA.LPVPVL |
| 206562684/116-447 | AGKFAFTVVTLASGFKGGEVTPLFYIGATLG....NALGQVLA.LPAPVL |
| 116691890/61-392 | AGKFAFTVVTLASGFKGGEVTPLFYIGATLG....NALGQVLA.LPVPVL |
| 107026913/61-392 | AGKFAFTVVTLASGFKGGEVTPLFYIGATLG....NALGQVLA.LPVPVL |
| 78063149/61-392 | AGKFAFTVVTLASGFKGGEVTPLFYIGATLG....NALGQVLA.LPVPVL |
| 224824608/61-392 | AAKMAFTVASLGSGFKGGEVTPLFYIGATLG....NALAPLLG.MPLPLL |
| 300697592/50-381 | AGKIAFTVVTLSSGFKGGEVTPLFYIGATLG....NALGYVLP.LPFPLL |
| 187925675/61-392 | AGKFGFTVVTLASGFKGGEVTPLFYIGATLG....NALGHVLA.LPMPVL |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 160897178/61-392 | LGKLVFTVASLGTGFKGGEVTPLFYIGATMG....NVLAPLLH.MPFALM |
| 207739311/50-381 | AGKIAFTVVTLSSGFKGGEVTPLFYIGATLG....NALGYVLP.LPFPLL |
| 300311782/61-392 | LGKMVFTVTSLGSGFKGGEVTPLFYIGATLG....NALAPLLH.LPFPLL |
| 83748726/62-393 | AGKIAFTVVTLSSGFKGGEVTPLFYIGATLG....NALGYVLP.LPFPLL |
| 17546522/50-381 | AGKAAFTIVTLASGFKGGEVTPLFYIGATLG....NALGYVLP.LPFALL |
| 207724636/50-381 | AGKIAFTVVTLSSGFKGGEVTPLFYIGATLG....NALGYVLP.LPFPLL |
| 166712100/61-392 | LGKLCFTAVSLGTGFKGGEVTPLFYIGATLG....NALAPLLH.LPFPML |
| 84624054/61-392 | LGKLCFTAVSLGTGFKGGEVTPLFYIGATLG....NALAPLLH.LPFPML |
| 58582162/61-392 | LGKLCFTAVSLGTGFKGGEVTPLFYIGATLG....NALAPLLH.LPFPML |
| 188576912/61-392 | LGKLCFTAVSLGTGFKGGEVTPLFYIGATLG....NALAPLLH.LPFPML |
| 188576721/61-392 | LGKLCFTAVSLGTGFKGGEVTPLFYIGATLG....NALAPLLH.LPFPML |
| 237728386/61-392 | MGKMSFTIVSLATGFKGGEVTPLFYIGATLG....NALAPLLH.MPFAFM |
| 34497884/61-392 | IGKLGFTVATLGSGFKGGEVTPLFYIGAALG....NMLAPLLH.LPFPLL |
| 285018239/61-392 | FGKFVFTVMSLGTGFKGGEVTPLFYIGATLG....NALAPLLH.LPFSLL |
| 66044733/61-398 | LGKMVFTVVSLGTGFKGGEVTPLFYIGATLG....NALAPLLH.LPFGML |
| 213971827/61-398 | LGKMVFTVVSLGTGFKGGEVTPLFYIGATLG....NALAPLLH.LPFGML |
| 171058747/61-392 | AAKLGLTVASLASGFKGGEVTPLFFIGATLG....NALAPLLQ.LPLGLL |
| 238025034/95-426 | AGKFAFTLVTLASGFKGGEVTPLFYIGATLG....NALSHLLA.LPLPVL |
| 229589423/61-398 | LGKMLFTVVSLGTGFKGGEVTPLFYIGATLG....NALAPLLH.LPFGML |
| 300693842/50-381 | AGKIAFTVVTLSSGFKGGEVTPLFYIGATLG....NALGYVLP.LPFPLL |
| 28871751/65-402 | LGKMVFTVVSLGTGFKGGEVTPLFYIGATLG....NALAPLLH.LPFGML |
| 237801960/61-398 | LGKMVFTVVSLGTGFKGGEVTPLFYIGATLG....NALAPLLH.LPFGML |
| 241665656/62-393 | AGKAAFTIVTLASGFKGGEVTPLFYIGATLG....NALGYVLP.LPFPLL |
| 187926168/62-393 | AGKAAFTIVTLASGFKGGEVTPLFYIGATLG....NALGYVLP.LPFPLL |
| 302059036/73-410 | LGKMVFTVVSLGTGFKGGEVTPLFYIGATLG....NALAPLLH.LPFGML |
| 309779037/62-393 | AGKAAFTIVTLASGFKGGEVTPLFYIGATLG....NALGYVLP.LPFPLL |
| 126698234/62-390 | LLKFILTILTLSAGFQGGEVTPLFSIGASLG....VLLAGFFN.LPIELV |
| 306519283/74-402 | LLKFILTILTLSAGFQGGEVTPLFSIGASLG....VLLAGFFN.LPIELV |
| 260685949/74-402 | LLKFILTILTLSAGFQGGEVTPLFSIGASLG....VLLAGFFN.LPIELV |
| 260682350/74-402 | LLKFILTILTLSAGFQGGEVTPLFSIGASLG....VLLAGFFN.LPIELV |
| 255649173/74-402 | LLKFILTILTLSAGFQGGEVTPLFSIGASLG....VLLAGFFN.LPIELV |
| 255516076/74-402 | LLKFILTILTLSAGFQGGEVTPLFSIGASLG....VLLAGFFN.LPIELV |
| 255313389/74-402 | LLKFILTILTLSAGFQGGEVTPLFSIGASLG....VLLAGFFN.LPIELV |
| 255091661/74-402 | LLKFILTILTLSAGFQGGEVTPLFSIGASLG....VLLAGFFN.LPIELV |
| 254974264/74-402 | LLKFILTILTLSAGFQGGEVTPLFSIGASLG....VLLAGFFN.LPIELV |
| 225868779/61-391 | LLKLLFTIITLSAGFQGGEVTPLFAIGAALG....IVLAPWLG.LPAQLA |
| 255099763/74-402 | LLKFILTILTLSAGFQGGEVTPLFSIGASLG....VLLAGFFN.LPIELV |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 255305648/74-402 | LLKFILTILTLSAGFQGGEVTPLFSIGASLG....VLLAGFFN.LPIELV |
| 225870265/61-391 | LLKLLFTIITLSAGFQGGEVTPLFAIGAALG....IVLAPWLG.LPAQLA |
| 296878238/74-402 | LLKFVLTILTLSAGFQGGEVTPLFSIGASLG....VLLAGFFN.LPIELV |
| 296449441/74-402 | LLKFVLTILTLSAGFQGGEVTPLFSIGASLG....VLLAGFFN.LPIELV |
| 255654699/74-402 | LLKFVLTILTLSAGFQGGEVTPLFSIGASLG....VLLAGFFN.LPIELV |
| 296876619/58-390 | ILKLLFTVVTISAGYQGGEVTPLFAIGATLG....VFLAPMLG.LPVLVV |
| 163790421/57-388 | LLKFLLTILSLAAGFQGGEVTPIFSIGASLG....VWLAPLFG.LPIEFV |
| 24379705/63-392 | LLKLFLTVITLAAGFQGGEVTPLFAIGSSLG....VVLAGIFH.LPLEFV |
| 290580296/63-392 | LLKLFLTVITLAAGFQGGEVTPLFAIGSSLG....VVLAGIFH.LPLEFV |
| 171780017/63-391 | LLKLVLTVATLAIGFQGGEVTPLFAIGASLG....VVLAKVFG.LPVEFV |
| 261407611/66-398 | LGKIIFTSLTLGAGFQGGEVTPLFAIGATLG....SALSEWIG.LHAPFL |
| 299137255/65-396 | AAKFLFTAVTLGTGFKGGEVTPLFYIGSTLG....NALSSLLP.LPPSLL |
| 237668509/58-389 | ILKFIFTIVTLAAGFQGGEVTPLFSIGASLG....VFLGNLMG.LPIELV |
| 182416531/58-389 | ILKFIFTIVTLAAGFQGGEVTPLFSIGASLG....VFLGNLMG.LPIELV |
| 288905673/63-391 | LLKLLLTVATLAIGFQGGEVTPLFAIGASLG....VVLANLFG.LPVEFV |
| 306831767/63-391 | LLKLLLTVATLAIGFQGGEVTPLFAIGASLG....VVLANLFG.LPVEFV |
| 125624281/58-389 | ILKLIFTVLSISAGFQGGEVTPLFAIGSTLG....AALAMLFG.LPVEFV |
| 306833893/72-400 | LLKLLLTVATLAIGFQGGEVTPLFAIGASLG....VVLANLFG.LPIEFV |
| 24379706/63-391 | LFKLILTVLTLSAGYQGGEVMPMFTIGATLG....AVLAPLFH.LPIAFV |
| 223936158/62-409 | WWKIVFTIVTISSGFKGGEVTPLFFIGATLG....NALSGLLH.APVDLF |
| 168216344/69-400 | LGKLIFTSITLGAGYQGGEVTPLFVIGSTLG....NTLSGILN.LPPSFL |
| 281491597/58-389 | ILKLIFTVLSISAGFQGGEVTPLFAIGSTLG....AALAMLFG.LPVEFV |
| 116627914/63-392 | LFKLLLTVFTLSLGFQGGEVTPLFAIGASLG....AVLAPILG.LPISLV |
| 290580295/63-391 | LFKLILTVLTLSAGYQGGEVMPMFTIGATLG....AVLAPLFH.LPIAFV |
| 15673080/58-389 | ILKLIFTVLSISAGFQGGEVTPLFAIGSTLG....AALAMLFG.LPVEFV |
| 116511937/58-389 | ILKLIFTVLSISAGFQGGEVTPLFAIGSTLG....AALAMLFG.LPVEFV |
| 257874163/61-390 | LLKLVLTVLTISSGFLGGEVTPLFAIGSSLG....VVLAPLFG.LPIELV |
| 257867835/61-390 | LLKLVLTVLTISSGFLGGEVTPLFAIGSSLG....VVLAPLFG.LPIELV |
| 55821189/63-392 | LFKLLLTVFTLSLGFQGGEVTPLFAIGASLG....AVLAPILG.LPISLV |
| 182626550/69-400 | LGKLIFTSITLGAGYQGGEVTPLFVIGSTLG....NTLSGILN.LSPSFL |
| 110803970/69-400 | LGKLIFTSITLGAGYQGGEVTPLFVIGSTLG....NTLSGILN.LSPSFL |
| 55823099/63-392 | LFKLLLTVFTLSLGFQGGEVTPLFAIGASLG....AVLAPILG.LPISLV |
| 209544766/77-424 | LWKLAFTVAALATGFKGGEVTPLFFIGAGLG....NALAPLLH.APVDLL |
| 169343074/69-400 | LGKLIFTSITLGAGYQGGEVTPLFVIGSTLG....NTLSGILN.LSPSFL |
| 110800437/69-400 | LGKLIFTSITLGAGYQGGEVTPLFVIGSTLG....NTLSGILN.LSPSFL |
| 168210325/69-400 | LGKLIFTSITLGAGYQGGEVTPLFVIGSTLG....NTLSGILN.LSPSFL |
| 253755995/54-382 | LLKLLLTCLCLAAGFQGGEVTPLFAIGASSG....AVLAGLLG.LPTELV |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 253754061/54-382 | LLKLLLTCLCLAAGFQGGEVTPLFAIGASSG....AVLAGLLG.LPTELV |
| 253752235/54-382 | LLKLLLTCLCLAAGFQGGEVTPLFAIGASSG....AVLAGLLG.LPTELV |
| 146321395/54-382 | LLKLLLTCLCLAAGFQGGEVTPLFAIGASSG....AVLAGLLG.LPTELV |
| 146319191/54-382 | LLKLLLTCLCLAAGFQGGEVTPLFAIGASSG....AVLAGLLG.LPTELV |
| 256423027/87-434 | LWKLLLTAITLGMGFKGGEVTPLFFIGATLG....HTLAVLMG.APVDLF |
| 168207393/69-400 | LGKIIFTSITLGAGYQGGEVTPLFVIGSTLG....NTLSGILN.LSPSFL |
| 168214512/69-400 | LGKLIFTSITLGAGYQGGEVTPLFVIGSTLG....NTLSGILN.LSPSFL |
| 18309572/69-400 | LGKLIFTSITLGAGYQGGEVTPLFVIGSTLG....NTLSGILN.LSPSFL |
| 162149525/77-424 | LWKLAFTVAALATGFKGGEVTPLFFIGAGLG....NALAPLLH.APVDLL |
| 196229369/63-411 | FWKIIFTAVTLSAGFKGGEVTPLFYIGAALG....NALAGIMG.APTDLF |
| 257876728/61-390 | LLKLVLTVLTISIGFLGGEVTPLFAIGSSLG....VVLAPLFG.LPIELV |
| 251797520/69-399 | LWKTIFTALTLGAGFQGGEVTPLFVIGATLG....NALAGLLH.LAAPFL |
| 195977885/1-309 | LLKLLFTIITLSAGFQGGEVTPLFAIGAALG....IVLAPWLG.LPAQLA |
| 222152807/62-391 | FFKLFFTVVTIAAGFQGGEVTPLFSIGASLG....IVLAPIFG.LPLETV |
| 59710638/60-408 | ILKLVLTAITLAAGYKGGEVTPLFFVGATLG....NFLGWVMG.APVDLF |
| 167766061/56-388 | LLKLLFTIFTLAIGFQGGEVTPLFSIGTSLG....VILGGLLG.LPPMLC |
| 228476400/63-392 | LLKLLLTVFTLSLGFQGGEVTPLFAIGASLG....AVLAPVLG.LPIPLV |
| 197334244/60-408 | ILKLVLTAITLAAGYKGGEVTPLFFVGATLG....NFLGWVMG.APVDLF |
| 284005894/64-409 | FWKLLFTAITLSSGFKGGEVTPLFFIGACLG....NLLAGWFN.APVDLF |
| 95928333/62-409 | WWKLLLTAITLSSGFKGGEVTPLFFVGATLG....AALAGVLG.VPVDLL |
| 307277103/61-391 | VGKLFFTVLSLGAGFQGGEVTPLFEIGATLG....SSLAPLLH.LSIPFL |
| 171911999/62-407 | LGKLLFTSVTLGSGFKGGEVTPLFYVGATLG....NAIGALLQ.EPVGLF |
| 257421896/61-391 | VGKLFFTVLSLGAGFQGGEVTPLFEIGATLG....SSLAPLLH.LSIPFL |
| 300779490/57-408 | LWKTVYTTVTLGTGFKGGEVTPLFYIGATLG....NTLSDLMN.APVGLF |
| 257416700/61-391 | VGKLFFTVLSLGAGFQGGEVTPLFEIGATLG....SSLAPLLH.LSIPFL |
| 307271571/61-391 | VGKLFFTVLSLGAGFQGGEVTPLFEIGATLG....SSLAPLLH.LSIPFL |
| 300860446/61-391 | VGKLFFTVLSLGAGFQGGEVTPLFEIGATLG....SSLAPLLH.LSIPFL |
| 257419916/61-391 | VGKLFFTVLSLGAGFQGGEVTPLFEIGATLG....SSLAPLLH.LSIPFL |
| 256963630/61-391 | VGKLFFTVLSLGAGFQGGEVTPLFEIGATLG....SSLAPLLH.LSIPFL |
| 256956740/61-391 | VGKLFFTVLSLGAGFQGGEVTPLFEIGATLG....SSLAPLLH.LSIPFL |
| 255972070/61-391 | VGKLFFTVLSLGAGFQGGEVTPLFEIGATLG....SSLAPLLH.LSIPFL |
| 229549364/61-391 | VGKLFFTVLSLGAGFQGGEVTPLFEIGATLG....SSLAPLLH.LSIPFL |
| 149280114/62-411 | LWKTIYTTLTLGTGFKGGEVTPLFYIGATLG....NALSTLLN.APVSLF |
| 307290483/61-391 | IGKLFFTVLSLGAGFQGGEVTPLFEIGATLG....SSLAPLLH.LSIPFL |
| 256853823/61-391 | IGKLFFTVLSLGAGFQGGEVTPLFEIGATLG....SSLAPLLH.LSIPFL |
| 256616980/61-391 | VGKLFFTVLSLGAGFQGGEVTPLFEIGATLG....SSLAPLLH.LSIPFL |
| 229545116/61-391 | VGKLFFTVLSLGAGFQGGEVTPLFEIGATLG....SSLAPLLH.LSIPFL |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 257081959/61-391 | VGKLFFTVLSLGAGFQGGEVTPLFEIGATLG....SSLAPLLH.LSIPFL |
| 307285753/61-391 | VGKLFFTVLSLGAGFQGGEVTPLFEIGATLG....SSLAPLLH.LSIPFL |
| 255975137/61-391 | VGKLFFTVLSLGAGFQGGEVTPLFEIGATLG....SSLAPLLH.LSIPFL |
| 257090652/61-391 | VGKLFFTVLSLGAGFQGGEVTPLFEIGATLG....SSLAPLLH.LSIPFL |
| 256763156/61-391 | VGKLFFTVLSLGAGFQGGEVTPLFEIGATLG....SSLAPLLH.LSIPFL |
| 29376957/61-391 | VGKLFFTVLSLGAGFQGGEVTPLFEIGATLG....SSLAPLLH.LSIPFL |
| 227553996/61-391 | VGKLFFTVLSLGAGFQGGEVTPLFEIGATLG....SSLAPLLH.LSIPFL |
| 307287657/61-391 | VGKLFFTVLSLGAGFQGGEVTPLFEIGATLG....SSLAPLLH.LSIPFL |
| 293387361/61-391 | VGKLFFTVLSLGAGFQGGEVTPLFEIGATLG....SSLAPLLH.LSIPFL |
| 293383526/61-391 | VGKLFFTVLSLGAGFQGGEVTPLFEIGATLG....SSLAPLLH.LSIPFL |
| 256961242/61-391 | VGKLFFTVLSLGAGFQGGEVTPLFEIGATLG....SSLAPLLH.LSIPFL |
| 300731132/63-397 | AAKSIFTAITLGAGFKGGEVTPLFFIGSTLG....NALSRLIP.LPSSLM |
| 257087493/61-391 | VGKLFFTVLSLGAGFQGGEVTPLFEIGATLG....SSLAPLLH.LSIPFL |
| 307270777/61-391 | VGKLFFTVLSLGAGFQGGEVTPLFEIGATLG....SSLAPLLH.LSIPFL |
| 294780852/61-391 | VGKLFFTVLSLGAGFQGGEVTPLFEIGATLG....SSLAPLLH.LSIPFL |
| 257079694/61-391 | VGKLFFTVLSLGAGFQGGEVTPLFEIGATLG....SSLAPLLH.LSIPFL |
| 222086761/62-408 | FWKAVFTIVTLSSGFKGGEVTPLFFIGAALG....NAIAAILG.APVDLF |
| 257084511/61-391 | VGKLFFTVLSLGAGFQGGEVTPLFEIGATLG....SSLAPLLH.LSIPFL |
| 240137886/73-417 | ALKILFTVVTLSAGFKGGEVTPLFFIGAALG....NALAGVLG.APVDLF |
| 302024216/54-382 | LLKLLLTCLCLAAGFQGGEVTPLFAIGASSG....VVLAGLLG.LPTELV |
| 222147858/69-416 | AWKALFTVVTLSAGFKGGEVTPLFFIGAGLG....NALAGLTG.APTDLF |
| 293559774/61-391 | IGKLFFTVLSLGAGYQGGEVTPLFEIGATLG....AVLAPLLH.VSVPFL |
| 260558935/61-391 | IGKLFFTVLSLGAGYQGGEVTPLFEIGATLG....AVLAPLLH.VSVPFL |
| 257890482/61-391 | IGKLFFTVLSLGAGYQGGEVTPLFEIGATLG....AVLAPLLH.VSVPFL |
| 154484719/61-393 | LLKLLLTVLTLSIGFQGGEVTPLFSIGASLG....IILGSFLG.ISPMLC |
| 227519818/61-391 | VGKLFFTVLSLGAGFQGGEVTPLFEIGATLG....SSLAPLLH.LSIPFL |
| 86143630/67-398 | LVKVLFTSFTLGAGFKGGEVTPLFYIGATLG....NALIWFIP.LPMDLL |
| 293568623/61-391 | IGKLFFTVLSLGAGYQGGEVTPLFEIGATLG....AVLAPLLH.VSVPFL |
| 251778279/66-397 | FNKLIFTSFTLGTGFQGGEVTPLFVIGSTLG....NTLSTILH.ISPSFL |
| 257886896/61-391 | IGKLFFTVLSLGAGYQGGEVTPLFEIGATLG....AVLAPLLQ.VSVPFL |
| 188588504/66-397 | FNKLIFTSFTLGTGFQGGEVTPLFVIGSTLG....NTLSTILH.ISPSFL |
| 293571654/61-391 | IGKLFFTVLSLGAGYQGGEVTPLFEIGATLG....AALAPLLH.VSVPFL |
| 300863903/61-393 | AAKIALTALTLGAGFKGGEVTPLFFIGATLG....NALSLILA.LPAPLL |
| 257895467/61-391 | IGKLFFTVLSLGAGYQGGEVTPLFETGATLG....AALAPLLH.VSVPFL |
| 257898081/61-391 | IGKLFFTVLSLGAGYQGGEVTPLFEIGATLG....AVLAPLLH.VSVPFL |
| 69249390/61-391 | IGKLFFTVLSLGAGYQGGEVTPLFEIGATLG....AALAPLLH.VSVPFL |
| 258614354/61-391 | IGKLFFTVLSLGAGYQGGEVTPLFEIGATLG....AALAPLLH.VSVPFL |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 257893085/61-391 | IGKLFFTVLSLGAGYQGGEVTPLFEIGATLG....AALAPLLH.VSVPFL |
| 257879974/61-391 | IGKLFFTVLSLGAGYQGGEVTPLFEIGATLG....AALAPLLH.VSVPFL |
| 294053809/63-411 | FWKLLLTAITLSFGFKGGEVTPLFFIGATLG....NALAVWMG.APIDLL |
| 149275805/8-356 | LWKNIFTAVTLGTGFKGGEVTPLFYMGATLG....NVLSVVLH.APVSLF |
| 293553829/61-391 | IGKLFFTVLSLGAGYQGGEVTPLFEIGATLG....AALAPLLH.VSVPFL |
| 224023708/79-410 | LLKLIFTTFTIGVGFKGGEVTPLFFVGATLG....SALSAVVP.LPMALL |
| 294623042/61-391 | IGKLFFTVLSLGAGYQGGEVTPLFEIGATLG....AALAPLLH.VSVPFL |
| 289567585/61-391 | IGKLFFTVLSLGAGYQGGEVTPLFEIGATLG....AALAPLLH.VSVPFL |
| 261209457/61-391 | IGKLFFTVLSLGAGYQGGEVTPLFEIGATLG....AALAPLLH.VSVPFL |
| 257884112/61-391 | IGKLFFTVLSLGAGYQGGEVTPLFEIGATLG....AALAPLLH.VSVPFL |
| 189460046/67-398 | LLKLIFTTFTIGVGFKGGEVTPLFFVGATLG....SALSFIIP.LPMSLL |
| 294620207/61-391 | IGKLFFTVLSLGAGYQGGEVTPLFEIGATLG....AALAPLLH.VSVPFL |
| 118579274/62-407 | WWKLLFTVITLGSGFKGGEVTPLFFIGAALG....NALALLMN.APVELF |
| 58040573/61-408 | FWKLVFTVTVLATGFKGGEVTPLFFLGAASG....NILAFLLH.VPVDLL |
| 187932697/74-404 | FNKLIFTSFTLGTGFQGGEVTPLFVIGSTFG....NTLSNILH.ISPSFL |
| 293378332/61-391 | IGKLFFTVLSLGAGYQGGEVTPLFETGATLG....AALAPLLH.VSVPFL |
| 296115670/62-409 | LYKLLFTVVVLATGYKGGEVTPLFFIGAGLG....NTLSGILG.VPADLL |
| 227551941/85-415 | IGKLFFTVLSLGAGYQGGEVTPLFETGATLG....AALAPLLH.VSVPFL |
| 294616356/61-391 | IGKLFFTVLSLGAGYQGGEVTPLFEIGATLG....AALAPLLH.VSVPFL |
| 257883083/61-391 | IGKLFFTVLSLGAGYQGGEVTPLFEIGATLG....AALAPLLH.VSVPFL |
| 253771312/60-391 | LGKLVFTSVTLGSGYQGGEVTPLFVIGSTLG....SSLSALLN.LSPSFL |
| 225166826/60-391 | LGKLVFTSVTLGSGYQGGEVTPLFVIGSTLG....SSLSALLN.LSPSFL |
| 307688608/69-400 | LGKIIFTSITLGTGFQGGEVTPFFFVGSTFG....NALGGILD.LSPIFL |
| 302873225/69-400 | LGKIIFTSITLGTGFQGGEVTPFFFVGSTFG....NALGGILD.LSPIFL |
| 87306694/62-420 | WWKLLFTAVTVGSGFKGGEVTPLFFIGAALG....NVTGVMLG.APVDLM |
| 88801314/65-397 | FLKLILTSFTLGAGFKGGEVTPLFFIGATLG....NVLIWFIP.LPMPLL |
| 218283679/62-391 | ILKFILTILTLSAGFQGGEVTPLFAIGSSLG....VIIAPVFG.LNPLFV |
| 240146274/81-413 | ILKLLLTILTLAIGYQGGEVTPLFSIGASLG....IVLGGILS.ISPVHC |
| 197301848/54-386 | ILKLGFTVLTLAIGFQGGEVTPLFSIGASLG....ILAGNLLG.ISPVVC |
| 198275782/67-397 | LLKILFTTFTIGVGFKGGEVTPLFFVGATLG....SALSAVVP.LPMGLL |
| 304404790/58-390 | AWKTLFTSLTLGAGYQGGEVTPLFAIGALLG....SALAGLLH.VSIPLL |
| 227540545/49-380 | ALKMAFTILTLAAGFKGGEVTPLFFIGATLG....SALSLFIP.LPLGLL |
| 260771568/62-409 | ILKLILTAITLAAGFKGGEVTPLFFIGATLG....NFLAWVMG.APVELF |
| 307818395/70-401 | AWKTIFTVVTLGLGFKGGEVTPLFFIGATMG....NALSAVLP.LPASLL |
| 300771325/49-380 | ALKMVFTILTLAAGFKGGEVTPLFFIGATLG....SALSLFIP.LPLGLL |
| 283796370/78-411 | ILKFFFTAVTIAAGFQGGEVTPLFSIGASLG....AALSLILP.LPLPLL |
| 300778780/74-405 | ALKMIFTIVTLSAGFKGGEVTPLFFIGATLG....SALSLFIP.LPFGLL |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 283856276/78-422 | LLKFIFTVVTLSTGFKGGEVTPLFFIGAALG....STIAHIIG.APVDLF |
| 260752944/61-405 | LLKFIFTVVTLSTGFKGGEVTPLFFIGAALG....STIAHIIG.APVDLF |
| 281418863/57-387 | MLKILFTALTLAAGYYGGEVVPLFSIGASAG....FVLANVLE.LPVELC |
| 241761090/61-405 | LLKFIFTVVTLSTGFKGGEVTPLFFVGAALG....STIAHIIG.APVDLF |
| 255533420/59-389 | ALKILFTAITLGSGFKGGEVTPLFFIGATLG....SALSVFLP.LPVGLL |
| 256004137/57-387 | MLKILFTALTLAAGYYGGEVVPLFSIGASAG....FVLANVLE.LPVELC |
| 251796733/53-386 | LWKTLFTSITLGSGFQGGEVTPLFVIGSTFG....SALAKLLA.VSVPLL |
| 125974665/60-390 | MLKILFTALTLAAGYYGGEVVPLFSIGASAG....FVLANVLG.LPIELC |
| 293374935/63-394 | LIKLLLTSITLATGFQGGEVTPLFVVGATFG....NFLAPLFN.LPLSFV |
| 149197279/60-400 | ALKLLFTSFTLGAGFKGGEVTPLFFIGATLG....SALSFIIP.LPLALL |
| 260584530/57-386 | LFKLGLTVFSLSAGFLGGEVTPLFSIGSSLG....IVMSSWLG.ISPMVA |
| 159897555/58-389 | ALKLLLTGLTLGVGFKGGEVTPLFVIGATLG....SALAQLFG.VPTDLL |
| 108757317/55-387 | AWKLAFTVVTLAAGFLGGEVTPLFFIGASLG....NVLARLLG.LPLDLG |
| 310817431/55-387 | AWKLLFTAVTLGAGFLGGEVTPLFFIGAALG....NVLARVLG.LPLDLG |
| 126645925/55-387 | LVKTGMTGFTLGAGFKGGEVTPLFFTGATLG....NALSTWIP.LPLALL |
| 115376569/2-329 | AWKLLFTAVTLGAGFLGGEVTPLFFIGAALG....NVLARVLG.LPLDLG |
| 153853007/62-402 | ILKMALTILTLSSGFIGGEVAPLFSIGSCLG....YVLGPVFG.FDPMFG |
| 189911881/62-391 | FWKLILTVITIGFGFKGGEVTPLFFIGASLG....NLFAILDP.VHLTLF |
| 183221808/62-391 | FWKLILTVITIGFGFKGGEVTPLFFIGASLG....NLFAILDP.VHLTLF |
| 146300126/58-389 | LLKILFTGFTLGAGFKGGEVTPLFFVGATLG....SALSIFIP.MPIALL |
| 283779250/63-421 | AWKTVFTAVTVGSGFKGGEVTPLFFIGAAGG....NAMGTLLS.APLGLL |
| 289639619/53-382 | PLKLLMTVLSLGAGFQGGEVTPLFDIGAGLG....GWLGLVAR.LSPSLL |
| 296122614/61-407 | LCKLLLTILTLACGLKGGEVTPLFFIGAALG....NVLAVKTGLLPVDVA |
| 241888810/58-377 | MLKIILTAICTGIGFSGGEVTPLFAIGATCG....VILGIWLG.LPILVT |
| | ................................................ |
| | alignment positions 351-400 |
| 94994029/66-396 | AALGYVTVFGSATNTFWAPIFIGIEVF........GPEN........A.. |
| 217422654/69-400 | AGLGFVAVFAGAANTPIASTIMAIELF........GAPI........G.. |
| 53722888/61-392 | AGLGFVAVFAGAANTPIASTIMAIELF........GAPI........G.. |
| 167915998/61-392 | AGLGFVAVFAGAANTPIASTIMAIELF........GAPI........G.. |
| 254208316/69-400 | AGLGFVAVFAGAANTPIASTIMAIELF........GAPI........G.. |
| 254202983/69-400 | AGLGFVAVFAGAANTPIASTIMAIELF........GAPI........G.. |
| 254177294/70-401 | AGLGFVAVFAGAANTPIASTIMAIELF........GAPI........G.. |
| 124381362/70-401 | AGLGFVAVFAGAANTPIASTIMAIELF........GAPI........G.. |
| 134278691/61-392 | AGLGFVAVFAGAANTPIASTIMAIELF........GAPI........G.. |
| 53716487/61-392 | AGLGFVAVFAGAANTPIASTIMAIELF........GAPI........G.. |
| 167002346/61-392 | AGLGFVAVFAGAANTPIASTIMAIELF........GAPI........G.. |
| 126447166/61-392 | AGLGFVAVFAGAANTPIASTIMAIELF........GAPI........G.. |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 121597200/61-392 | AGLGFVAVFAGAAANTPIASTIMAIELF........GAPI........G.. |
| 126442778/69-400 | AGLGFVAVFAGAAANTPIASTIMAIELF........GAPI........G.. |
| 28896294/62-392 | AALGYVTVFGSATNTFWAPIFIGIEVF........GPEN........A.. |
| 21910009/62-392 | AALGYVTVFGSATNTFWAPIFIGIEVF........GPEN........A.. |
| 242313952/69-400 | AGLGFVAVFAGAAANTPIASTIMAIELF........GAPI........G.. |
| 126458603/69-400 | AGLGFVAVFAGAAANTPIASTIMAIELF........GAPI........G.. |
| 76818704/69-400 | AGLGFVAVFAGAAANTPIASTIMAIELF........GAPI........G.. |
| 254264654/69-400 | AGLGFVAVFAGAAANTPIASTIMAIELF........GAPI........G.. |
| 226195674/69-400 | AGLGFVAVFAGAAANTPIASTIMAIELF........GAPI........G.. |
| 237508459/69-400 | AGLGFVAVFAGAAANTPIASTIMAIELF........GAPI........G.. |
| 167724759/61-392 | AGLGFVAVFAGAAANTPIASTIMAIELF........GAPI........G.. |
| 254186015/61-392 | AGLGFVAVFAGAAANTPIASTIMAIELF........GAPI........G.. |
| 167829250/61-392 | AGLGFVAVFAGAAANTPIASTIMAIELF........GAPI........G.. |
| 254184798/61-392 | AGLGFVAVFAGAAANTPIASTIMAIELF........GAPI........G.. |
| 167850723/61-392 | AGLGFVAVFAGAAANTPIASTIMAIELF........GAPI........G.. |
| 167743705/61-392 | AGLGFVAVFAGAAANTPIASTIMAIELF........GAPI........G.. |
| 257141781/61-392 | AGLGFVAVFAGAAANTPIASTIMAIELF........GAPI........G.. |
| 167615218/61-392 | AGLGFVAVFAGAAANTPIASTIMAIELF........GAPI........G.. |
| 254194484/61-392 | AGLGFVAVFAGAAANTPIASTIMAIELF........GAPI........G.. |
| 167907659/61-392 | AGLGFVAVFAGAAANTPIASTIMAIELF........GAPI........G.. |
| 254301074/61-392 | AGLGFVAVFAGAAANTPIASTIMAIELF........GAPI........G.. |
| 167923842/61-392 | AGLGFVAVFAGAAANTPIASTIMAIELF........GAPI........G.. |
| 167577039/61-392 | AGLGFVAVFAGAAANTPIASTIMAIELF........GAPI........G.. |
| 94990116/66-396 | AALGYVTVFGSAINTFWAPIFIGIEVF........GPEN........A.. |
| 83716137/69-400 | AGLGFVAVFAGAAANTPIASTIMAIELF........GAPI........G.. |
| 94988234/66-396 | AALGYTTVFGSATNTFWAPIFIGIEVF........GPEN........A.. |
| 71903194/66-396 | AALGYTTVFGSATNTFWAPIFIGIEVF........GPEN........A.. |
| 94992108/66-396 | AALGYTTVFGSATNTFWAPIFIGIEVF........GPEN........A.. |
| 306827662/62-392 | AALGYATVFGSATNTFWAPIFIGIEVF........GPEN........A.. |
| 19745820/62-392 | AALGYATVFGSATNTFWAPIFIGIEVF........GPEN........A.. |
| 139474077/62-392 | AALGYATVFGSATNTFWAPIFIGIEVF........GPEN........A.. |
| 71910363/62-392 | AALGYTTVFGSATNTFWAPIFIGIEVF........GPEN........A.. |
| 50913916/66-396 | AALGYTTVFGSATNTFWAPIFIGIEVF........GPEN........A.. |
| 209559106/62-392 | AALGYTTVFGSATNTFWAPIFIGIEVF........GPEN........A.. |
| 15674779/62-392 | AALGYTTVFGSATNTFWAPIFIGIEVF........GPEN........A.. |
| 167566636/61-392 | AGLGFVAVFAGAAANTPIASTIMAIELF........GAPI........G.. |
| 167573712/61-392 | AGLGFVAVFAGAAANTPIASTIMAIELF........GAPI........G.. |

TABLE 6-continued

Sequences and alignments of examples of fluoride transporters. The first column lists the GI number for the protein in the NCBI RefSeq database and, following the slash, the amino acids positions of the protein that are aligned in the table.

| GI/positions | Sequence |
|---|---|
| 251782109/62-392 | AALGYATVFGSATNTFWAPIFIGMEVF........GPDN........A.. |
| 66768521/61-392 | AGLGLVAVFAGASNTPIASTLMAVELF........GADI........A.. |
| 21231425/61-392 | AGLGLVAVFAGASNTPIASTLMAVELF........GADI........A.. |
| 188991670/81-412 | AGLGLVAVFAGASNTPIASTLMAVELF........GADI........A.. |
| 221210981/61-392 | AALGFVAVFAGAANTPIASTIMAIELF........GADI........G.. |
| 189352355/61-392 | AALGFVAVFAGAANTPIASTIMAIELF........GADI........G.. |
| 161521476/61-392 | AALGFVAVFAGAANTPIASTIMAIELF........GADI........G.. |
| 221203824/61-392 | AALGFVAVFAGAANTPIASTIMAIELF........GADI........G.. |
| 221197152/61-392 | AALGFVAVFAGAANTPIASTIMAIELF........GADI........G.. |
| 77408502/58-387 | AALGYTSVFGSATNTLLGPILIGGEVF........GFAN........T.. |
| 167583829/60-391 | AGLGFVAVFAGAANTPVASTIMAIELF........GADI........G.. |
| 77411121/58-387 | AALGYTSVFGSATNTLLGPILIGGEVF........GFAN........T.. |
| 76798380/58-387 | AALGYTSVFGSATNTLLGPILIGGEVF........GFAN........T.. |
| 76787827/58-387 | AALGYTSVFGSATNTLLGPILIGGEVF........GFAN........T.. |
| 25010655/58-387 | AALGYTSVFGSATNTLLGPILIGGEVF........GFAN........T.. |
| 22536719/58-387 | AALGYTSVFGSATNTLLGPILIGGEVF........GFAN........T.. |
| 170701178/116-447 | AGLGFVAVFAGAANTPIASTIMAIELF........GADV........G.. |
| 134292888/61-392 | AGLGFVAVFAGAANTPIASTIMAIELF........GADL........G.. |
| 115360262/61-392 | AGLGFVAVFAGAANTPIASTIMAIELF........GADV........G.. |
| 172062717/116-447 | AGLGFVAVFAGAANTPIASTIMAIELF........GADV........G.. |
| 170736113/61-392 | AGLGFVAVFAGAANTPIASTIMAIELF........GADI........G.. |
| 254248860/130-461 | AGLGFVAVFAGAANTPIASTIMAIELF........GADI........G.. |
| 206562684/116-447 | AGLGFVAVFAGAANTPIASTIMAIELF........GADI........G.. |
| 116691890/61-392 | AGLGFVAVFAGAANTPIASTIMAIELF........GADI........G.. |
| 107026913/61-392 | AGLGFVAVFAGAANTPIASTIMAIELF........GADI........G.. |
| 78063149/61-392 | AGLGFVAVFAGAANTPIASTIMAIELF........GADI........G.. |
| 224824608/61-392 | AGIGFVAVFAGAANTPIASTLMAMELF........GSEI........G.. |
| 300697592/50-381 | AGLGFVAVFAGAANTPIASTIMAIELF........GPEV........G.. |
| 187925675/61-392 | AGLGFVAVFAGAANTPIASTVMAIELF........GADI........G.. |
| 160897178/61-392 | AAIGFVAVFAGAANTPIATTLMAMELF........GAGI........G.. |
| 207739311/50-381 | AGLGFVAVFAGAANTPIASTIMAIELF........GPEV........G.. |
| 300311782/61-392 | AGIGFVAVFAGAANTPLASTIMAIELF........GPQI........G.. |
| 83748726/62-393 | AGLGFVAVFAGAANTPIASTIMAIELF........GPEV........G.. |
| 17546522/50-381 | AGLGFVAVFAGAANTPIASTIMAIELF........GPEV........G.. |
| 207724636/50-381 | AGLGFVAVFAGAANTPIASTIMAIELF........GPEV........G.. |
| 166712100/61-392 | AGIGFVAVFAGASNTPIASTLMAVELF........GADI........A.. |
| 84624054/61-392 | AGIGFVALFAGASNTPIASTLMAVELF........GADI........A.. |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 58582162/61-392 | AGIGFVALFAGASNTPIASTLMAVELF........GADI........A.. |
| 188576912/61-392 | AGIGFVALFAGASNTPIASTLMAVELF........GADI........A.. |
| 188576721/61-392 | AGIGFVALFAGASNTPIASTLMAVELF........GADI........A.. |
| 237728386/61-392 | AGIGFVAVFAGAANTPLATTFMAMELF........GTEM........A.. |
| 34497884/61-392 | AGMGFVAVFAGAANTPLASTVMALELF........GSEI........G.. |
| 285018239/61-392 | AGIGFVAVFSGAANTPIATTLMAMELF........GADI........G.. |
| 66044733/61-398 | AGIGFVAVFAGAANTPLATIVMAMELF........GPEI........A.. |
| 213971827/61-398 | AGIGFVAVFAGAANTPLATIVMAMELF........GPEI........A.. |
| 171058747/61-392 | AALGFVAVFAGAANTPLACTLMAMELF........GAQI........G.. |
| 238025034/95-426 | AGLGFVAVFAGAANTPIASTIMAIELF........GAPI........G.. |
| 229589423/61-398 | AGIGFVAVFAGAANTPLATIVMAMELF........GPEI........A.. |
| 300693842/50-381 | AGLGFVAVFAGAANTPIASTIMAIELF........GPEV........G.. |
| 28871751/65-402 | AGIGFVAVFAGAANTPLATIVMAMELF........GPEI........A.. |
| 237801960/61-398 | AGIGFVAVFAGAANTPLATIVMAMELF........GPEI........A.. |
| 241665656/62-393 | AGLGFVAVFAGAANTPIASTLMAMELF........GPEV........G.. |
| 187926168/62-393 | AGLGFVAVFAGAANTPIASTLMAMELF........GPEV........G.. |
| 302059036/73-410 | AGIGFVAVFAGAANTPLATIVMAMELF........GPEI........A.. |
| 309779037/62-393 | AGLGFVAVFAGAANTPIASTLMAMELF........GPEV........G.. |
| 126698234/62-390 | AALGYASVFGSATNTFFAPVFIGAEVF........GYSY........L.. |
| 306519283/74-402 | AALGYASVFGSATNTFFAPVFIGAEVF........GYSY........L.. |
| 260685949/74-402 | AALGYASVFGSATNTFFAPVFIGAEVF........GYSY........L.. |
| 260682350/74-402 | AALGYASVFGSATNTFFAPVFIGAEVF........GYSY........L.. |
| 255649173/74-402 | AALGYASVFGSATNTFFAPVFIGAEVF........GYSY........L.. |
| 255516076/74-402 | AALGYASVFGSATNTFFAPVFIGAEVF........GYSY........L.. |
| 255313389/74-402 | AALGYASVFGSATNTFFAPVFIGAEVF........GYSY........L.. |
| 255091661/74-402 | AALGYASVFGSATNTFFAPVFIGAEVF........GYSY........L.. |
| 254974264/74-402 | AALGYASVFGSATNTFFAPVFIGAEVF........GYSY........L.. |
| 225868779/61-391 | AALGYAAVFGSATNTFLAPIFVGLEVF........GATN........A.. |
| 255099763/74-402 | AALGYASVFGSATNTFFAPVFIGAEVF........GYSY........L.. |
| 255305648/74-402 | AALGYASVFGSATNTFFAPVFIGAEVF........GYSY........L.. |
| 225870265/61-391 | AALGYAAVFGSATNTFLAPIFVGLEVF........GATN........A.. |
| 296878238/74-402 | AALGYASVFGSATNTFFAPVFIGAEVF........GYSY........L.. |
| 296449441/74-402 | AALGYASVFGSATNTFFAPVFIGAEVF........GYSY........L.. |
| 255654699/74-402 | AALGYASVFGSATNTFFAPVFIGAEVF........GYSY........L.. |
| 296876619/58-390 | AAIGYASVFGSATTTLLAPILIGGEVF........GYAN........L.. |
| 163790421/57-388 | AALGYASVFSSATNTLIAPALIGAEVF........GFNY........L.. |
| 24379705/63-392 | AALGYISVFGSATNTFLAPILIGGEVF........GYQN........L.. |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 290580296/63-392 | AALGYISVFGSATNTFLAPILIGGEVF........GYQN........L... |
| 171780017/63-391 | AAAGYISVFGSATNTLLAPIFIGGEVF........GFAN........L... |
| 261407611/66-398 | AALGFIAVFCGATNTPIACFIMGIELF........GGEG........A... |
| 299137255/65-396 | AGMGFVAVFAGAANTPIASTLMAVELF........GAEA........G... |
| 237668509/58-389 | AALGYACVFGGATNTFIAPIFIGAEVF........GFEY........V... |
| 182416531/58-389 | AALGYACVFGGATNTFIAPIFIGAEVF........GFEY........V... |
| 288905673/63-391 | AAAGYISVFGSATNTLIAPIFIGGEVF........GFAN........L... |
| 306831767/63-391 | AAAGYISVFGSATNTLIAPIFIGGEVF........GFAN........L... |
| 125624281/58-389 | AAAGYVSIFSAATNSYFGPIFIAAEVF........GFGS........V... |
| 306833893/72-400 | AAAGYISVFGSATNTLIAPIFIGGEVF........GFAN........L... |
| 24379706/63-391 | AALGYASVFGSGTSTFLAPIFIGGEIF........GFEN........I... |
| 223936158/62-409 | AGLGFIGVFAGATNTPLACTIMGIELF........GAHY........T... |
| 168216344/69-400 | ASLGLVGVFAGATNTPIASFVLGIEMF........GVGG........A... |
| 281491597/58-389 | AAAGYVSIFSAATNSYFGPIFIAAEVF........GFGS........V... |
| 116627914/63-392 | AGLGYLSVFGSSTNTLLAPIFIGIEVF........GPAN........A... |
| 290580295/63-391 | AALGYASVFGSGTSTFLAPIFIGGEIF........GFEN........I... |
| 15673080/58-389 | AAAGYVSIFSAATNSYFGPIFIAAEVF........GFGS........V... |
| 116511937/58-389 | AAAGYVSIFSAATNSYFGPIFIAAEVF........GFGS........V... |
| 257874163/61-390 | AALGYASVFGSATSTLFAPIFIGGEVF........GFQN........L... |
| 257867835/61-390 | AALGYASVFGSATSTLFAPIFIGGEVF........GFQN........L... |
| 55821189/63-392 | AGLGYLSVFGSSTNTLLAPIFIGIEVF........GPAN........A... |
| 182626550/69-400 | ASLGLVGVFAGATNTPIASFVLGIELF........GVGG........A... |
| 110803970/69-400 | ASLGLVGVFAGATNTPIASFVLGIEMF........GVGG........A... |
| 55823099/63-392 | AGLGYLSVFGSSTNTLLAPIFIGIEIF........GPVN........A... |
| 209544766/77-424 | AAVGFVAVFAGAANTPLACTLMGIELF........GAAD........I... |
| 169343074/69-400 | ASLGLVGVFAGATNTPIASFVLGIEMF........GVGG........A... |
| 110800437/69-400 | ASLGLVGVFAGATNTPIASFVLGIEMF........GVGG........A... |
| 168210325/69-400 | ASLGLVGVFAGATNTPIASFVLGIEMF........GVGG........A... |
| 253755995/54-382 | AALGYCAVFGTATNTLLAPLFISYEVF........GANI........L... |
| 253754061/54-382 | AALGYCAVFGTATNTLLAPLFISYEVF........GANI........L... |
| 253752235/54-382 | AALGYCAVFGTATNTLLAPLFISYEVF........GANI........L... |
| 146321395/54-382 | AALGYCAVFGTATNTLLAPLFISYEVF........GANI........L... |
| 146319191/54-382 | AALGYCAVFGTATNTLLAPLFISYEVF........GANI........L... |
| 256423027/87-434 | AGLGFIAVFAGATNTPIACTLMGVELF........GTTH........V... |
| 168207393/69-400 | ASLGLVGVFAGATNTPIASFVLGIEMF........GVGG........A... |
| 168214512/69-400 | ASLGLVGVFAGATNTPIASFVLGIEMF........GVGG........A... |
| 18309572/69-400 | ASLGLVGVFAGATNTPIASFVLGIEMF........GVGG........A... |

TABLE 6-continued

Sequences and alignments of examples of fluoride transporters. The first column lists the GI number for the protein in the NCBI RefSeq database and, following the slash, the amino acids positions of the protein that are aligned in the table.

| GI/positions | Sequence |
|---|---|
| 162149525/77-424 | AAVGFVAVFAGAANTPLACTLMGIELF........GAAD........I.. |
| 196229369/63-411 | AALGFVAIFAGASNTPLACTLMGVELF........GATH........V.. |
| 257876728/61-390 | AALGYASVFGSATSTLFAPIFIGGEVF........GFQN........L.. |
| 251797520/69-399 | AGLGFIAVFSGATNTPIACFIMGIELF........GSEG........A.. |
| 195977885/1-309 | AALGYAAVFGSATNTFLAPIFVGLEVF........GATN........A.. |
| 222152807/62-391 | AALGYISVFSSATNTFLAPFLIGFEVF........GPEH........F.. |
| 59710638/60-408 | AALGFLAVFAAATNTPLACTIMGVELF........GAEY........L.. |
| 167766061/56-388 | AALGYAAVFGSATNTLIAPIMIGLEVF........GGAD........M.. |
| 228476400/63-392 | AGLGYLSVFGSSTNTLLAPIFIGIEVF........GPAN........A.. |
| 197334244/60-408 | AALGFLAVFAAATNTPLACTIMGVELF........GSEY........L.. |
| 284005894/64-409 | AALGFIAIFAGASNTPLASTLMGLELF........GSDN........L.. |
| 95928333/62-409 | AGIGFIAVFAGATNTPLACTLMGVELF........GAQY........L.. |
| 307277103/61-391 | AGLGFIGVFSGATNTPIACFIMGIELF........GSEA........A.. |
| 171911999/62-407 | AALGFIAVFAGAANTPLACTLMGIELF........GAHY........A.. |
| 257421896/61-391 | AGLGFIGVFSGATNTPIACFIMGIELF........GSEA........A.. |
| 300779490/57-408 | AALGFIAVFSGATNTPLACTLMGIELF........GGEY........T.. |
| 257416700/61-391 | AGLGFIGVFSGATNTPIACFIMGIELF........GSEA........A.. |
| 307271571/61-391 | AGLGFIGVFSGATNTPIACFIMGIELF........GSEA........A.. |
| 300860446/61-391 | AGLGFIGVFSGATNTPIACFIMGIELF........GSEA........A.. |
| 257419916/61-391 | AGLGFIGVFSGATNTPIACFIMGIELF........GSEA........A.. |
| 256963630/61-391 | AGLGFIGVFSGATNTPIACFIMGIELF........GSEA........A.. |
| 256956740/61-391 | AGLGFIGVFSGATNTPIACFIMGIELF........GSEA........A.. |
| 255972070/61-391 | AGLGFIGVFSGATNTPIACFIMGIELF........GSEA........A.. |
| 229549364/61-391 | AGLGFIGVFSGATNTPIACFIMGIELF........GSEA........A.. |
| 149280114/62-411 | AALGFIAVFAGATNTPLACTIMGIELF........GSEY........T.. |
| 307290483/61-391 | AGLGFIGVFSGATNTPIACFIMGIELF........GSEA........A.. |
| 256853823/61-391 | AGLGFIGVFSGATNTPIACFIMGIELF........GSEA........A.. |
| 256616980/61-391 | AGLGFIGVFSGATNTPIACFIMGIELF........GSEA........A.. |
| 229545116/61-391 | AGLGFIGVFSGATNTPIACFIMGIELF........GSEA........A.. |
| 257081959/61-391 | AGLGFIGVFSGATNTPIACFIMGIELF........GSEA........A.. |
| 307285753/61-391 | AGLGFIGVFSGATNTPIACFIMGIELF........GSEA........A.. |
| 255975137/61-391 | AGLGFIGVFSGATNTPIACFIMGIELF........GSEA........A.. |
| 257090652/61-391 | AGLGFIGVFSGATNTPIACFIMGIELF........GSEA........A.. |
| 256763156/61-391 | AGLGFIGVFSGATNTPIACFIMGIELF........GSEA........A.. |
| 29376957/61-391 | AGLGFIGVFSGATNTPIACFIMGIELF........GSEA........A.. |
| 227553996/61-391 | AGLGFIGVFSGATNTPIACFIMGIELF........GSEA........A.. |
| 307287657/61-391 | AGLGFIGVFSGATNTPIACFIMGIELF........GSEA........A.. |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 293387361/61-391 | AGLGFIGVFSGATNTPIACFIMGIELF........GSEA........A... |
| 293383526/61-391 | AGLGFIGVFSGATNTPIACFIMGIELF........GSEA........A... |
| 256961242/61-391 | AGLGFIGVFSGATNTPIACFIMGIELF........GSEA........A... |
| 300731132/63-397 | AGMGFVAVFAGAANTPIASTLMAVELF........GGEA........G... |
| 257087493/61-391 | AGLGFIGVFSGATNTPIACFIMGIELF........GSEA........A... |
| 307270777/61-391 | AGLGFIGVFSGATNTPIACFIMGIELF........GSEA........A... |
| 294780852/61-391 | AGLGFIGVFSGATNTPIACFIMGIELF........GSEA........A... |
| 257079694/61-391 | AGLGFIGVFSGATNTPIACFIMGIELF........GSEA........A... |
| 222086761/62-408 | AALGFVAVFAGATNTPLACMIMGIELF........GATH........T... |
| 257084511/61-391 | AGLGFIGVFSGATNTPIACFIMGIELF........GSEA........A... |
| 240137886/73-417 | AALGFVAVFAGAANTPLACTLMGIELF........GATH........G... |
| 302024216/54-382 | AALGYCAVFGTATNTLLAPLFISYEVF........GANI........L... |
| 222147858/69-416 | AGLGFVAVFAGATNTPLACMIMGLELF........GATH........A... |
| 293559774/61-391 | AGLGFIGVFSGATNTPIACFVMGIELF........GSQA........A... |
| 260558935/61-391 | AGLGFIGVFSGATNTPIACFVMGIELF........GSQA........A... |
| 257890482/61-391 | AGLGFIGVFSGATNTPIACFVMGIELF........GSQA........A... |
| 154484719/61-393 | AALGYAAVFGSATNTLMAPIMLGIEVF........GGNN........M... |
| 227519818/61-391 | AGLGFIGVFSGATNTPIACFIMGIELF........GSEA........A... |
| 86143630/67-398 | AGMGFVAVFAGATNTPIACTIMGIELF........GIES........G... |
| 293568623/61-391 | AGLGFIGVFSGATNTPIACFVMGIELF........GSQA........A... |
| 251778279/66-397 | AALGLIGVFAGATNSPITSFILGLELF........GAQG........I... |
| 257886896/61-391 | AGLGFIGVFSGATNTPIACFVMGIELF........GSQA........A... |
| 188588504/66-397 | AALGLIGVFAGATNSPITSFILGLELF........GAQG........I... |
| 293571654/61-391 | AGLGFIGVFSGATNTPIACFVMGIELF........GSQA........A... |
| 300863903/61-393 | AGMGFVAVFGGAANTPIASTLMGIELF........GLES........G... |
| 257895467/61-391 | AGLGFIGVFSGATNTPIACFVMGIELF........GSQA........A... |
| 257898081/61-391 | VGLGFIGVFSGATNTPIACFVMGIELF........GSQA........A... |
| 69249390/61-391 | AGLGFIGVFSGATNTPIACFVMGIELF........GSQA........A... |
| 258614354/61-391 | AGLGFIGVFSGATNTPIACFVMGIELF........GSQA........A... |
| 257893085/61-391 | AGLGFIGVFSGATNTPIACFVMGIELF........GSQA........A... |
| 257879974/61-391 | AGLGFIGVFSGATNTPIACFVMGIELF........GSQA........A... |
| 294053809/63-411 | AGLGFIAVFAGATNTPLACTLMGVELF........GAEN........L... |
| 149275805/8-356 | AALGFIAVFSGATKTPFACTLMGAELF........GIQY........L... |
| 293553829/61-391 | AGLGFIGVFSGATNTPIACFVMGIELF........GSQA........A... |
| 224023708/79-410 | AGLGFVAVFAGATNTPIACTLMGIELF........GAEA........G... |
| 294623042/61-391 | AGLGFIGVFSGATNTPIACFVMGIELF........GSQA........A... |
| 289567585/61-391 | AGLGFIGVFSGATNTPIACFVMGIELF........GSQA........A... |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 261209457/61-391 | AGLGFIGVFSGATNTPIACFVMGIELF........GSQA........A.. |
| 257884112/61-391 | AGLGFIGVFSGATNTPIACFVMGIELF........GSQA........A.. |
| 189460046/67-398 | AGLGFVAVFAGATNTPIACTFMGIELF........GIEP........G.. |
| 294620207/61-391 | AGLGFIGVFSGATNTPIACFVMGIELF........GSQA........A.. |
| 118579274/62-407 | AALGFVAVFAGASNTPLACTLMGIELF........GASC........S.. |
| 58040573/61-408 | AAVGFVSVFAGAANTPLACTLMGVELF........GAGD........I.. |
| 187932697/74-404 | AALGLIGVFAGATNAPITSFILGLELF........GAQG........I.. |
| 293378332/61-391 | AGLGFIGVFSGATNTPIACFVMGIELF........GSQA........A.. |
| 296115670/62-409 | ASVGFVAVFAGAANTPLACTFMGVELF........GATD........I.. |
| 227551941/85-415 | AGLGFIGVFSGATNTPIACFVMGIELF........GSQA........A.. |
| 294616356/61-391 | AGLGFIGVFSGATNTPIACFVMGIELF........GSQA........A.. |
| 257883083/61-391 | AGLGFIGVFSGATNTPIACFVMGIELF........GSQA........A.. |
| 253771312/60-391 | ASLGLISVFTGATNTPIASFILGIEMF........GSKG........A.. |
| 225166826/60-391 | ASLGLISVFTGATNTPIASFILGIEMF........GSKG........A.. |
| 307688608/69-400 | AGLGLVAVFCGATNTPIASFFLGLELF........HGEA........V.. |
| 302873225/69-400 | AGLGLVAVFCGATNTPIASFFLGLELF........HGEA........V.. |
| 87306694/62-420 | AGLGFVAVFAGATNTPLACTIMAIELF........GPGNGELLSSGFV.. |
| 88801314/65-397 | AGMGFVAVFAGATNTPIACTIMGIELF........GIES........G.. |
| 218283679/62-391 | ASLGYCSVFGAATNTFLAPIAIGMEVF........GYQY........F.. |
| 240146274/81-413 | AALGYAAVFAGATNTLLAPVLIGLEVF........GAND........M.. |
| 197301848/54-386 | AALGYAAVFGSATNTLLAPVMIGLEVF........GTEN........A.. |
| 198275782/67-397 | AGIGFVAVFAGATNTPIACTLMGIELF........GAEP........G.. |
| 304404790/58-390 | AAVGLISVFSGAANTPFACFVMGLELF........GVDG........A.. |
| 227540545/49-380 | AGMGFVAVFSGATNTPLACSIMGIELF........GAEA........A.. |
| 260771568/62-409 | AALGFLAVFAAAANTPLACIIMGVELF........GADH........L.. |
| 307818395/70-401 | AGMGFVAVFAGAAKTPIASTIMAFELF........GPVP........G.. |
| 300771325/49-380 | AGMGFVAVFSGATNTPLACSIMGIELF........GAQA........A.. |
| 283796370/78-411 | AALGYAAVFGGATNTFLAPVFIGAEVF........GCEL........L.. |
| 300778780/74-405 | AGMGFVAVFAGATNTPLACMLMGIELF........GAEC........G.. |
| 283856276/78-422 | AGIGFIAVFGAAANTPLACIIMGVEMF........GADN........I.. |
| 260752944/61-405 | AGIGFIAVFGAAANTPLACIIMGVEMF........GADN........I.. |
| 281418863/57-387 | VALGYVAVFGSATNTFFAPLFISTEIF........GTEY........L.. |
| 241761090/61-405 | AGIGFIAVFGAAANTPLACIIMGVEMF........GADN........I.. |
| 255533420/59-389 | AGMGFVAVFAGAAKTPLACCLMAMELF........GLSC........G.. |
| 256004137/57-387 | VALGYVAVFGSATNTFFAPLFISTEIF........GTEY........L.. |
| 251796733/53-386 | AGIGLISIFSGATNTPLASFILGLELF........GLQG........YGW |
| 125974665/60-390 | VALGYAAVFGSATNTFFAPLFISTEIF........GTEY........L.. |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 293374935/63-394 | AGLGMIGVFCGGTKTPLASFAMGLELF........GGGN........L... |
| 149197279/60-400 | AAIGFVGVFSGATNTPIACTLMGIELF........GAQI........G... |
| 260584530/57-386 | AALGYGAVFGSATNTWLAPIFIIGEVF........GYSM........M... |
| 159897555/58-389 | AALGFIAVFAGAANTPIACVLMGVELF........GSAL........L... |
| 108757317/55-387 | AAVGMAALFAAAANTPLALSIMAVELL........GANV........L... |
| 310817431/55-387 | AAVGMAALFAAAANTPLALTIMAVELV........GASV........L... |
| 126645925/55-387 | AGMGFVGVFSGATNTPMACTVMGMELF........GYES........G... |
| 115376569/2-329 | AAVGMAALFAAAANTPLALTIMAVELV........GASV........L... |
| 153853007/62-402 | AALGFASVFCSGSNTLLAAILVGVESF........GYNM........L... |
| 189911881/62-391 | VSVGFISVFSGATNTPLACAVMGMELF........GFQS........G... |
| 183221808/62-391 | VSVGFISVFSGATNTPLACAVMGMELF........GFQS........G... |
| 146300126/58-389 | AGVGFVSVFSGATHTPIACTIMGMELF........GIQP........G... |
| 283779250/63-421 | AAVGFVSLFAAATKTPLASTLMGIELFVHGGDDLVGSGL........V... |
| 289639619/53-382 | AALGMISVFGCAANTPLTTLIMGFELF........GNQS........L... |
| 296122614/61-407 | AALGFVAVFSAATNAPLASSVLAIELF........GPDR........I... |
| 241888810/58-377 | AALGYCLVFSAATKTYITPIFLALEVF........GYKL........M... |
| | ........................................... |
| | alignment positions 401-415 |
| 94994029/66-396 | LAYFVTSAAAYMIS. (SEQ ID NO: 61) |
| 217422654/69-400 | VYAALACVVAYLFSG (SEQ ID NO: 62) |
| 53722888/61-392 | VYAALACVVAYLFSG (SEQ ID NO: 63) |
| 167915998/61-392 | VYAALACVVAYLFSG (SEQ ID NO: 64) |
| 254208316/69-400 | VYAALACVVAYLFSG (SEQ ID NO: 65) |
| 254202983/69-400 | VYAALACVVAYLFSG (SEQ ID NO: 66) |
| 254177294/70-401 | VYAALACVVAYLFSG (SEQ ID NO: 67) |
| 124381362/70-401 | VYAALACVVAYLFSG (SEQ ID NO: 68) |
| 134278691/61-392 | VYAALACVVAYLFSG (SEQ ID NO: 69) |
| 53716487/61-392 | VYAALACVVAYLFSG (SEQ ID NO: 70) |
| 167002346/61-392 | VYAALACVVAYLFSG (SEQ ID NO: 71) |
| 126447166/61-392 | VYAALACVVAYLFSG (SEQ ID NO: 72) |
| 121597200/61-392 | VYAALACVVAYLFSG (SEQ ID NO: 73) |
| 126442778/69-400 | VYAALACVVAYLFSG (SEQ ID NO: 74) |
| 28896294/62-392 | LAYFVTSAAAYMVS. (SEQ ID NO: 75) |
| 21910009/62-392 | LAYFVTSAAAYMVS. (SEQ ID NO: 76) |
| 242313952/69-400 | VYAALACVVAYLFSG (SEQ ID NO: 77) |
| 126458603/69-400 | VYAALACVVAYLFSG (SEQ ID NO: 78) |
| 76818704/69-400 | VYAALACVVAYLFSG (SEQ ID NO: 79) |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 254264654/69-400 | VYAALACVVAYLFSG (SEQ ID NO: 80) |
| 226195674/69-400 | VYAALACVVAYLFSG (SEQ ID NO: 81) |
| 237508459/69-400 | VYAALACVVAYLFSG (SEQ ID NO: 82) |
| 167724759/61-392 | VYAALACVVAYLFSG (SEQ ID NO: 83) |
| 254186015/61-392 | VYAALACVVAYLFSG (SEQ ID NO: 84) |
| 167829250/61-392 | VYAALACVVAYLFSG (SEQ ID NO: 85) |
| 254184798/61-392 | VYAALACVVAYLFSG (SEQ ID NO: 86) |
| 167850723/61-392 | VYAALACVVAYLFSG (SEQ ID NO: 87) |
| 167743705/61-392 | VYAALACVVAYLFSG (SEQ ID NO: 88) |
| 257141781/61-392 | VYAALACVVAYLFSG (SEQ ID NO: 89) |
| 167615218/61-392 | VYAALACVVAYLFSG (SEQ ID NO: 90) |
| 254194484/61-392 | VYAALACVVAYLFSG (SEQ ID NO: 91) |
| 167907659/61-392 | VYAALACVVAYLFSG (SEQ ID NO: 92) |
| 254301074/61-392 | VYAALACVVAYLFSG (SEQ ID NO: 93) |
| 167923842/61-392 | VYAALACVVAYLFSG (SEQ ID NO: 94) |
| 167577039/61-392 | VYAALACVVAYLFSG (SEQ ID NO: 95) |
| 94990116/66-396 | LAYFVTSAAAYMVS. (SEQ ID NO: 96) |
| 83716137/69-400 | VYAALACVVAYLFSG (SEQ ID NO: 97) |
| 94988234/66-396 | LAYFVTSAAAYMVS. (SEQ ID NO: 98) |
| 71903194/66-396 | LAYFVTSAAAYMVS. (SEQ ID NO: 99) |
| 94992108/66-396 | LAYFVTSAAAYMVS. (SEQ ID NO: 100) |
| 306827662/62-392 | LAYFVTSAAAYMVS. (SEQ ID NO: 101) |
| 19745820/62-392 | LAYFVTSAAAYMVS. (SEQ ID NO: 102) |
| 139474077/62-392 | LAYFVTSAAAYMVS. (SEQ ID NO: 103) |
| 71910363/62-392 | LAYFVTSAAAYMVS. (SEQ ID NO: 104) |
| 50913916/66-396 | LAYFVTSAAAYMVS. (SEQ ID NO: 105) |
| 209559106/62-392 | LAYFVTSAAAYMVS. (SEQ ID NO: 106) |
| 15674779/62-392 | LAYFVTSAAAYMVS. (SEQ ID NO: 107) |
| 167566636/61-392 | VYAALACVVAYLFSG (SEQ ID NO: 108) |
| 167573712/61-392 | VYAALACVVAYLFSG (SEQ ID NO: 109) |
| 251782109/62-392 | LAYFVTAAAAYMVS. (SEQ ID NO: 110) |
| 66768521/61-392 | SFAAVACITAYLFSG (SEQ ID NO: 111) |
| 21231425/61-392 | SFAAVACITAYLFSG (SEQ ID NO: 112) |
| 188991670/81-412 | SFAAVACITAYLFSG (SEQ ID NO: 113) |
| 221210981/61-392 | VYAIVACVVAYLFSG (SEQ ID NO: 114) |
| 189352355/61-392 | VYAIVACVVAYLFSG (SEQ ID NO: 115) |
| 161521476/61-392 | VYAIVACVVAYLFSG (SEQ ID NO: 116) |

TABLE 6-continued

Sequences and alignments of examples of fluoride transporters. The first column lists the GI number for the protein in the NCBI RefSeq database and, following the slash, the amino acids positions of the protein that are aligned in the table.

| | | |
|---|---|---|
| 221203824/61-392 | VYAIVACVVAYLFSG | (SEQ ID NO: 117) |
| 221197152/61-392 | VYAIVACVVAYLFSG | (SEQ ID NO: 118) |
| 77408502/58-387 | PYFVIVCLVAYSIS. | (SEQ ID NO: 119) |
| 167583829/60-391 | VHAIVACVVAYLFSG | (SEQ ID NO: 120) |
| 77411121/58-387 | PYFVIVCLVAYSIS. | (SEQ ID NO: 121) |
| 76798380/58-387 | PYFVIVCLVAYSIS. | (SEQ ID NO: 122) |
| 76787827/58-387 | PYFVIVCLVAYSIS. | (SEQ ID NO: 123) |
| 25010655/58-387 | PYFVIVCLVAYSIS. | (SEQ ID NO: 124) |
| 22536719/58-387 | PYFVIVCLVAYSIS. | (SEQ ID NO: 125) |
| 170701178/116-447 | VYAIVACVVAYLFSG | (SEQ ID NO: 126) |
| 134292888/61-392 | VYAIVACVVAYLFSG | (SEQ ID NO: 127) |
| 115360262/61-392 | VYAIVACVVAYLFSG | (SEQ ID NO: 128) |
| 172062717/116-447 | VYAIVACVVAYLFSG | (SEQ ID NO: 129) |
| 170736113/61-392 | VYAIVACVVAYLFSG | (SEQ ID NO: 130) |
| 254248860/130-461 | VYAIVACVVAYLFSG | (SEQ ID NO: 131) |
| 206562684/116-447 | VYAIVACVVAYLFSG | (SEQ ID NO: 132) |
| 116691890/61-392 | VYAIVACVVAYLFSG | (SEQ ID NO: 133) |
| 107026913/61-392 | VYAIVACVVAYLFSG | (SEQ ID NO: 134) |
| 78063149/61-392 | VYAIVACVVAYLFSG | (SEQ ID NO: 135) |
| 224824608/61-392 | VYASIACVVSYLFSG | (SEQ ID NO: 136) |
| 300697592/50-381 | TFAGMACVVSYLFSG | (SEQ ID NO: 137) |
| 187925675/61-392 | MYAALACVVAYLFSG | (SEQ ID NO: 138) |
| 160897178/61-392 | PLAAIGCVTAYLFSG | (SEQ ID NO: 139) |
| 207739311/50-381 | TFAGMACVVSYLFSG | (SEQ ID NO: 140) |
| 300311782/61-392 | PFAALACVVAYLFSG | (SEQ ID NO: 141) |
| 83748726/62-393 | TFAGMACVVSYLFSG | (SEQ ID NO: 142) |
| 17546522/50-381 | TFAGIACVVSYLFSG | (SEQ ID NO: 143) |
| 207724636/50-381 | TFAGMACVVSYLFSG | (SEQ ID NO: 144) |
| 166712100/61-392 | PLAAIGCITAYLFSG | (SEQ ID NO: 145) |
| 84624054/61-392 | PLAAIGCITAYLFSG | (SEQ ID NO: 146) |
| 58582162/61-392 | PLAAIGCITAYLFSG | (SEQ ID NO: 147) |
| 188576912/61-392 | PLAAIGCITAYLFSG | (SEQ ID NO: 148) |
| 188576721/61-392 | PLAAIGCITAYLFSG | (SEQ ID NO: 149) |
| 237728386/61-392 | VFSAVGCFTAYLFSG | (SEQ ID NO: 150) |
| 34497884/61-392 | VYAGMACVVAYLFSG | (SEQ ID NO: 151) |
| 285018239/61-392 | PLAAIGCVTAYLFSG | (SEQ ID NO: 152) |
| 66044733/61-398 | PLAAIACIASYLVSG | (SEQ ID NO: 153) |

TABLE 6-continued

Sequences and alignments of examples of fluoride transporters. The first column lists the GI number for the protein in the NCBI RefSeq database and, following the slash, the amino acids positions of the protein that are aligned in the table.

| GI/positions | Sequence |
|---|---|
| 213971827/61-398 | PLAAIACIASYLVSG (SEQ ID NO: 154) |
| 171058747/61-392 | VYAGLACVVSYLFSG (SEQ ID NO: 155) |
| 238025034/95-426 | VFAALACVVAYLFSG (SEQ ID NO: 156) |
| 229589423/61-398 | PLAAIACIASYLVSG (SEQ ID NO: 157) |
| 300693842/50-381 | TFAGIACVVSYLFSG (SEQ ID NO: 158) |
| 28871751/65-402 | PLAAIACIASYLVSG (SEQ ID NO: 159) |
| 237801960/61-398 | PLAAIACIASYLVSG (SEQ ID NO: 160) |
| 241665656/62-393 | TFAGIACVVSYLFSG (SEQ ID NO: 161) |
| 187926168/62-393 | TFAGIACVVSYLFSG (SEQ ID NO: 162) |
| 302059036/73-410 | PLAAIACIASYLVSG (SEQ ID NO: 163) |
| 309779037/62-393 | TFAGIACVVSYLFSG (SEQ ID NO: 164) |
| 126698234/62-390 | PYFFVVCAISYIF.. (SEQ ID NO: 165) |
| 306519283/74-402 | PYFFVVCAISYIF.. (SEQ ID NO: 166) |
| 260685949/74-402 | PYFFVVCAISYIF.. (SEQ ID NO: 167) |
| 260682350/74-402 | PYFFVVCAISYIF.. (SEQ ID NO: 168) |
| 255649173/74-402 | PYFFVVCAISYIF.. (SEQ ID NO: 169) |
| 255516076/74-402 | PYFFVVCAISYIF.. (SEQ ID NO: 170) |
| 255313389/74-402 | PYFFVVCAISYIF.. (SEQ ID NO: 171) |
| 255091661/74-402 | PYFFVVCAISYIF.. (SEQ ID NO: 172) |
| 254974264/74-402 | PYFFVVCAISYIF.. (SEQ ID NO: 173) |
| 225868779/61-391 | TAYFIVIAFAYMVS. (SEQ ID NO: 174) |
| 255099763/74-402 | PYFFVVCAISYIF.. (SEQ ID NO: 175) |
| 255305648/74-402 | PYFFVVCAISYIF.. (SEQ ID NO: 176) |
| 225870265/61-391 | TAYFIVIAFAYMVS. (SEQ ID NO: 177) |
| 296878238/74-402 | PYFFVVCAISYVF.. (SEQ ID NO: 178) |
| 296449441/74-402 | PYFFVVCAISYVF.. (SEQ ID NO: 179) |
| 255654699/74-402 | PYFFVVCAISYVF.. (SEQ ID NO: 180) |
| 296876619/58-390 | PFFVIACAIAYCL.. (SEQ ID NO: 181) |
| 163790421/57-388 | PYFLLTVCISYVFNG (SEQ ID NO: 182) |
| 24379705/63-392 | PAYFIAVTFAYVV.. (SEQ ID NO: 183) |
| 290580296/63-392 | PAYFIAVTFAYVV.. (SEQ ID NO: 184) |
| 171780017/63-391 | PYFALVMIFAYSL.. (SEQ ID NO: 185) |
| 261407611/66-398 | VYMFMACVISYLFSG (SEQ ID NO: 186) |
| 299137255/65-396 | AFAGIACIISYLFSG (SEQ ID NO: 187) |
| 237668509/58-389 | PLFFVACSLAYIFNG (SEQ ID NO: 188) |
| 182416531/58-389 | PLFFVACSLAYIFNG (SEQ ID NO: 189) |
| 288905673/63-391 | PYFVVVMIFAYSV.. (SEQ ID NO: 190) |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 306831767/63-391 | PYFVVVMIFAYSV.. (SEQ ID NO: 191) |
| 125624281/58-389 | QYILPIMTIAYVLNG (SEQ ID NO: 192) |
| 306833893/72-400 | PYFVVVMIFAYSV.. (SEQ ID NO: 193) |
| 24379706/63-391 | PYFFIVVCFASI... (SEQ ID NO: 194) |
| 223936158/62-409 | VYFAAACFIAYFFSG (SEQ ID NO: 195) |
| 168216344/69-400 | PYLFMACAISYIFSG (SEQ ID NO: 196) |
| 281491597/58-389 | QYILPIMTIAYVLNG (SEQ ID NO: 197) |
| 116627914/63-392 | IPYAIVMAFAYII.. (SEQ ID NO: 198) |
| 290580295/63-391 | PYFFIVVCFASI... (SEQ ID NO: 199) |
| 15673080/58-389 | QYILPIMTIAYVLNG (SEQ ID NO: 200) |
| 116511937/58-389 | QYILPIMTIAYVLNG (SEQ ID NO: 201) |
| 257874163/61-390 | PFFVIVCSVAYFIS. (SEQ ID NO: 202) |
| 257867835/61-390 | PFFVIVCSVAYFIS. (SEQ ID NO: 203) |
| 55821189/63-392 | IPYAIVMAFAYLI.. (SEQ ID NO: 204) |
| 182626550/69-400 | PYLFMACAISYIFSG (SEQ ID NO: 205) |
| 110803970/69-400 | PYLFMACAISYIFSG (SEQ ID NO: 206) |
| 55823099/63-392 | IPYAIVMAFAYLI.. (SEQ ID NO: 207) |
| 209544766/77-424 | VYLAVGCFVAYLCSG (SEQ ID NO: 208) |
| 169343074/69-400 | PYLFMACAISYIFSG (SEQ ID NO: 209) |
| 110800437/69-400 | PYLFMACAISYIFSG (SEQ ID NO: 210) |
| 168210325/69-400 | PYLFMACAISYIFSG (SEQ ID NO: 211) |
| 253755995/54-382 | PYAIPVLAIAYLI.. (SEQ ID NO: 212) |
| 253754061/54-382 | PYAIPVLAIAYLI.. (SEQ ID NO: 213) |
| 253752235/54-382 | PYAIPVLAIAYLI.. (SEQ ID NO: 214) |
| 146321395/54-382 | PYAIPVLAIAYLI.. (SEQ ID NO: 215) |
| 146319191/54-382 | PYAIPVLAIAYLI.. (SEQ ID NO: 216) |
| 256423027/87-434 | LYFAVACFTAYYFSG (SEQ ID NO: 217) |
| 168207393/69-400 | PYLFMACAISYIFSG (SEQ ID NO: 218) |
| 168214512/69-400 | PYLFMACAISYIFSG (SEQ ID NO: 219) |
| 18309572/69-400 | PYLFMACAISYIFSG (SEQ ID NO: 220) |
| 162149525/77-424 | VYLAVGCFIAYLCSG (SEQ ID NO: 221) |
| 196229369/63-411 | IYIATACFLAYLFSG (SEQ ID NO: 222) |
| 257876728/61-390 | PFFVIVCSVAYFIS. (SEQ ID NO: 223) |
| 251797520/69-399 | LYMFMACMISYLFSG (SEQ ID NO: 224) |
| 195977885/1-309 | TAYFIVIAFAYMVS. (SEQ ID NO: 225) |
| 222152807/62-391 | LYYFIVLVFAYSI.. (SEQ ID NO: 226) |
| 59710638/60-408 | PYFALACYTAYYFSG (SEQ ID NO: 227) |

TABLE 6-continued

Sequences and alignments of examples of fluoride transporters. The first column lists the GI number for the protein in the NCBI RefSeq database and, following the slash, the amino acids positions of the protein that are aligned in the table.

| GI/positions | Sequence |
|---|---|
| 167766061/56-388 | VLFVIVCVIAYGVNG (SEQ ID NO: 228) |
| 228476400/63-392 | LPYAIVMAFAYLI.. (SEQ ID NO: 229) |
| 197334244/60-408 | PYFALACYTAYYFSG (SEQ ID NO: 230) |
| 284005894/64-409 | IFFAIACFVAYFFSG (SEQ ID NO: 231) |
| 95928333/62-409 | EYFAIACFLSYLFSG (SEQ ID NO: 232) |
| 307277103/61-391 | VYFFMVCLISFMCSG (SEQ ID NO: 233) |
| 171911999/62-407 | VYFAVACFVAFMASG (SEQ ID NO: 234) |
| 257421896/61-391 | VYFFMVCLISFMCSG (SEQ ID NO: 235) |
| 300779490/57-408 | LYYAIACFTAYFFSG (SEQ ID NO: 236) |
| 257416700/61-391 | VYFFMVCLISFMCSG (SEQ ID NO: 237) |
| 307271571/61-391 | VYFFMVCLISFMCSG (SEQ ID NO: 238) |
| 300860446/61-391 | VYFFMVCLISFMCSG (SEQ ID NO: 239) |
| 257419916/61-391 | VYFFMVCLISFMCSG (SEQ ID NO: 240) |
| 256963630/61-391 | VYFFMVCLISFMCSG (SEQ ID NO: 241) |
| 256956740/61-391 | VYFFMVCLISFMCSG (SEQ ID NO: 242) |
| 255972070/61-391 | VYFFMVCLISFMCSG (SEQ ID NO: 243) |
| 229549364/61-391 | VYFFMVCLISFMCSG (SEQ ID NO: 244) |
| 149280114/62-411 | MFFAVACFTAYFFSG (SEQ ID NO: 245) |
| 307290483/61-391 | VYFFMVCLISFMCSG (SEQ ID NO: 246) |
| 256853823/61-391 | VYFFMVCLISFMCSG (SEQ ID NO: 247) |
| 256616980/61-391 | VYFFMVCLISFMCSG (SEQ ID NO: 248) |
| 229545116/61-391 | VYFFMVCLISFMCSG (SEQ ID NO: 249) |
| 257081959/61-391 | VYFFMVCLISFMCSG (SEQ ID NO: 250) |
| 307285753/61-391 | VYFFMVCLISFMCSG (SEQ ID NO: 251) |
| 255975137/61-391 | VYFFMVCLISFMCSG (SEQ ID NO: 252) |
| 257090652/61-391 | VYFFMVCLISFMCSG (SEQ ID NO: 253) |
| 256763156/61-391 | VYFFMVCLISFMCSG (SEQ ID NO: 254) |
| 29376957/61-391 | VYFFMVCLISFMCSG (SEQ ID NO: 255) |
| 227553996/61-391 | VYFFMVCLISFMCSG (SEQ ID NO: 256) |
| 307287657/61-391 | VYFFMVCLISFMCSG (SEQ ID NO: 257) |
| 293387361/61-391 | VYFFMVCLISFMCSG (SEQ ID NO: 258) |
| 293383526/61-391 | VYFFMVCLISFMCSG (SEQ ID NO: 259) |
| 256961242/61-391 | VYFFMVCLISFMCSG (SEQ ID NO: 260) |
| 300731132/63-397 | AYAGIACVISYLFSG (SEQ ID NO: 261) |
| 257087493/61-391 | VYFFMVCLISFMCSG (SEQ ID NO: 262) |
| 307270777/61-391 | VYFFMVCLISFMCSG (SEQ ID NO: 263) |
| 294780852/61-391 | VYFFMVCLISFMCSG (SEQ ID NO: 264) |

TABLE 6-continued

Sequences and alignments of examples of fluoride transporters. The first column lists the GI number for the protein in the NCBI RefSeq database and, following the slash, the amino acids positions of the protein that are aligned in the table.

| | |
|---|---|
| 257079694/61-391 | VYFFMVCLISFMCSG (SEQ ID NO: 265) |
| 222086761/62-408 | VYLAVACFLAYICSG (SEQ ID NO: 266) |
| 257084511/61-391 | VYFFMVCLISFMCSG (SEQ ID NO: 267) |
| 240137886/73-417 | VYLAVACFIAYLCSG (SEQ ID NO: 268) |
| 302024216/54-382 | PYAIPVLAIAYLI.. (SEQ ID NO: 269) |
| 222147858/69-416 | VYLAVACFTAYLTSG (SEQ ID NO: 270) |
| 293559774/61-391 | AYFFMICLISFMCSG (SEQ ID NO: 271) |
| 260558935/61-391 | AYFFMICLISFMCSG (SEQ ID NO: 272) |
| 257890482/61-391 | AYFFMICLISFMCSG (SEQ ID NO: 273) |
| 154484719/61-393 | LASVVVCSLAYVVNG (SEQ ID NO: 274) |
| 227519818/61-391 | VYFFMVCLISFMCSG (SEQ ID NO: 275) |
| 86143630/67-398 | VFIAIACSTAYLFSG (SEQ ID NO: 276) |
| 293568623/61-391 | VYFFMICLISFMCSG (SEQ ID NO: 277) |
| 251778279/66-397 | EFMFMTCAISYLFSG (SEQ ID NO: 278) |
| 257886896/61-391 | VYFFMICLISFMCSG (SEQ ID NO: 279) |
| 188588504/66-397 | EFMFMTCAISYLFSG (SEQ ID NO: 280) |
| 293571654/61-391 | VYFFMICLISFMCSG (SEQ ID NO: 281) |
| 300863903/61-393 | VFIAIACVMSYVFSG (SEQ ID NO: 282) |
| 257895467/61-391 | VYFFMICLISFMCSG (SEQ ID NO: 283) |
| 257898081/61-391 | AYFFMICLISFMCSG (SEQ ID NO: 284) |
| 69249390/61-391 | VYFFMICLISFMCSG (SEQ ID NO: 285) |
| 258614354/61-391 | VYFFMICLISFMCSG (SEQ ID NO: 286) |
| 257893085/61-391 | VYFFMICLISFMCSG (SEQ ID NO: 287) |
| 257879974/61-391 | VYFFMICLISFMCSG (SEQ ID NO: 288) |
| 294053809/63-411 | IYYAIACFTAYYFSG (SEQ ID NO: 289) |
| 149275805/8-356 | LFFALACFIAYWCSG (SEQ ID NO: 290) |
| 293553829/61-391 | VYFFMICLISFMCSG (SEQ ID NO: 291) |
| 224023708/79-410 | LYLGIACVIAYLFSG (SEQ ID NO: 292) |
| 294623042/61-391 | VYFFMICLISFMCSG (SEQ ID NO: 293) |
| 289567585/61-391 | VYFFMICLISFMCSG (SEQ ID NO: 294) |
| 261209457/61-391 | VYFFMICLISFMCSG (SEQ ID NO: 295) |
| 257884112/61-391 | VYFFMICLISFMCSG (SEQ ID NO: 296) |
| 189460046/67-398 | IYLGIACVVAYLFSG (SEQ ID NO: 297) |
| 294620207/61-391 | VYFFMICLISFMCSG (SEQ ID NO: 298) |
| 118579274/62-407 | LYFAIACFLSYLCSG (SEQ ID NO: 299) |
| 58040573/61-408 | VYFATGCFVAYACSG (SEQ ID NO: 300) |
| 187932697/74-404 | EFMFMTCAISYLFSG (SEQ ID NO: 301) |

TABLE 6-continued

Sequences and alignments of examples of fluoride transporters. The first column lists the GI number for the protein in the NCBI RefSeq database and, following the slash, the amino acids positions of the protein that are aligned in the table.

| GI/positions | Sequence |
|---|---|
| 293378332/61-391 | VYFFMICLISFMCSG (SEQ ID NO: 302) |
| 296115670/62-409 | VYIATGCFVAYLCSG (SEQ ID NO: 303) |
| 227551941/85-415 | VYFFMICLISFMCSG (SEQ ID NO: 304) |
| 294616356/61-391 | VYFFMICLISFMCSG (SEQ ID NO: 305) |
| 257883083/61-391 | VYFFMICLISFMCSG (SEQ ID NO: 306) |
| 253771312/60-391 | IYMLIACSISYTFSG (SEQ ID NO: 307) |
| 225166826/60-391 | IYMLIACSISYTFSG (SEQ ID NO: 308) |
| 307688608/69-400 | IYLFIACIISYLFSG (SEQ ID NO: 309) |
| 302873225/69-400 | IYLFIACIISYLFSG (SEQ ID NO: 310) |
| 87306694/62-420 | VYAAIACFLSYFLSG (SEQ ID NO: 311) |
| 88801314/65-397 | VFIALACTTSYLFSG (SEQ ID NO: 312) |
| 218283679/62-391 | PFFFVVCAISYIV.. (SEQ ID NO: 313) |
| 240146274/81-413 | VPFLIVCIFAYLVNG (SEQ ID NO: 314) |
| 197301848/54-386 | IPLVVVCILAYLMNG (SEQ ID NO: 315) |
| 198275782/67-397 | LYLGIACVVAYLFSG (SEQ ID NO: 316) |
| 304404790/58-390 | IYLFIGCIVAWICS. (SEQ ID NO: 317) |
| 227540545/49-380 | VYIAIACILAYLFSG (SEQ ID NO: 318) |
| 260771568/62-409 | IYFALVCFIAYYASG (SEQ ID NO: 319) |
| 307818395/70-401 | CFAAIACVASYLCSG (SEQ ID NO: 320) |
| 300771325/49-380 | VYIAIACILAYLFSG (SEQ ID NO: 321) |
| 283796370/78-411 | PCFFIVCAAARLFNG (SEQ ID NO: 322) |
| 300778780/74-405 | VYVAIACVVSYLLSG (SEQ ID NO: 323) |
| 283856276/78-422 | VYFAAGCCTAYIFSG (SEQ ID NO: 324) |
| 260752944/61-405 | VYFAAGCCTAYIFSG (SEQ ID NO: 325) |
| 281418863/57-387 | PVFAAVCAIAYMFNG (SEQ ID NO: 326) |
| 241761090/61-405 | VYFAAGCCTAYIFSG (SEQ ID NO: 327) |
| 255533420/59-389 | IYVAIACTVSFFISG (SEQ ID NO: 328) |
| 256004137/57-387 | PVFAAVCAIAYMFNG (SEQ ID NO: 329) |
| 251796733/53-386 | LYMLIGCAVAYLCSG (SEQ ID NO: 330) |
| 125974665/60-390 | PVFAAVCAIAYMFNG (SEQ ID NO: 331) |
| 293374935/63-394 | KYLFITCVISYVFAG (SEQ ID NO: 332) |
| 149197279/60-400 | IYLGLSCVVAYIFSG (SEQ ID NO: 333) |
| 260584530/57-386 | PYAAIVCIVAFVVNG (SEQ ID NO: 334) |
| 159897555/58-389 | GPLMLTTCIAYAISG (SEQ ID NO: 335) |
| 108757317/55-387 | PHVAIVATVAYLLTG (SEQ ID NO: 336) |
| 310817431/55-387 | PHVAIVAALAYLLTG (SEQ ID NO: 337) |
| 126645925/55-387 | LYLAIACFIAYVFSG (SEQ ID NO: 338) |

TABLE 6-continued

Sequences and alignments of examples of fluoride transporters. The first column lists the GI number for the protein in the NCBI RefSeq database and, following the slash, the amino acids positions of the protein that are aligned in the table.

| GI/positions | Sequence | |
|---|---|---|
| 115376569/2-329 | PHVAIVAALAYLLTG | (SEQ ID NO: 339) |
| 153853007/62-402 | PFFSVVCFVSFIF.. | (SEQ ID NO: 340) |
| 189911881/62-391 | VVFFIATQIAYIMSG | (SEQ ID NO: 341) |
| 183221808/62-391 | VVFFIATQIAYIMSG | (SEQ ID NO: 342) |
| 146300126/58-389 | IFIALGCTIAYFSSG | (SEQ ID NO: 343) |
| 283779250/63-421 | IYLAVGCYVASWVSG | (SEQ ID NO: 344) |
| 289639619/53-382 | PFVVIAVFVSYYVSG | (SEQ ID NO: 345) |
| 296122614/61-407 | EYVFAACFSAWLVAG | (SEQ ID NO: 346) |
| 241888810/58-377 | LFVVIPAILIYLI.. | (SEQ ID NO: 347) |

Unless defined otherwise, all technical and scientific terms used herein have the same meanings as commonly understood by one of skill in the art to which the disclosed invention belongs. Publications cited herein and the materials for which they are cited are specifically incorporated by reference.

Those skilled in the art will recognize, or be able to ascertain using no more than routine experimentation, many equivalents to the specific embodiments of the invention described herein. Such equivalents are intended to be encompassed by the following claims.

SEQUENCE LISTING (353 sequences)

SEQ ID NO: 1 - DNA, 44 bp, Artificial Sequence
  Synthetic primer
  MISC (1)..(17): T7 RNA polymerase promoter
taatacgactcactataggatcggcgcattggagatggcattcc

SEQ ID NO: 2 - DNA, 21 bp, Artificial Sequence
  Synthetic primer
caggtttctgtaggcatcatc

SEQ ID NO: 3 - DNA, 34 bp, Artificial Sequence
  Synthetic primer
  MISC (1)..(17): T7 RNA polymerase promoter
taatacgactcactataggatcggcgcattggag

SEQ ID NO: 4 - DNA, 33 bp, Artificial Sequence
  Synthetic primer
caggtttctgtagggttcatcagctgctacggg

SEQ ID NO: 5 - DNA, 38 bp, Artificial Sequence
  Synthetic primer
cggcgcattggagatgggtttcctccattaacaaaccg

SEQ ID NO: 6 - DNA, 38 bp, Artificial Sequence
  Synthetic primer
cggtttgttaatggaggaaacccatctccaatgcgccg

SEQ ID NO: 7 - DNA, 44 bp, Artificial Sequence
  Synthetic primer
  MISC (1)..(17): T7 RNA polymerase promoter
taatacgactcactataggactaacacccgtggaatggcgtttc

SEQ ID NO: 8 - DNA, 45 bp, Artificial Sequence
  Synthetic primer
cacccgtggaatggcgtttccactcgtacaaaccgccagctccag

SEQ ID NO: 9 - DNA, 45 bp, Artificial Sequence
  Synthetic primer
tttcaatcaggcgtcatcagtcagctggagctggcggtttgtacg

SEQ ID NO: 10 - DNA, 49 bp, Artificial Sequence
  Synthetic primer
  MISC (1)..(17): T7 RNA polymerase promoter
  MISC (1)..(19): T7 RNA polymerase promoter
taatacgactcactataggataacccaacgggcgatgaggcccgcccaa

SEQ ID NO: 11 - DNA, 49 bp, Artificial Sequence
  Synthetic primer
cagtagaggccatcagccctcttcagggcagtttgggcgggcctcatcg

SEQ ID NO: 12 - DNA, 54 bp, Artificial Sequence
  Synthetic primer
  MISC (1)..(17): T7 RNA polymerase promoter
taatacgactcactataggatcggcgcattggagccggcattcctccattaaca

SEQ ID NO: 13 - DNA, 32 bp, Artificial Sequence
  Synthetic primer
caggtttctgtgggcatcatcagctgctacgg

SEQ ID NO: 14 - DNA, 33 bp, Artificial Sequence
  Synthetic primer
caggtttctgtacgcatcatcagctgctacggg

SEQ ID NO: 15 - DNA, 44 bp, Artificial Sequence
  Synthetic primer
caggtttctgtaggcatcatctgctgctacgggcgcagcggttt

SEQ ID NO: 16 - DNA, 66 bp, Artificial Sequence
  Synthetic primer
  MISC (1)..(17): T7 RNA polymerase promoter
taatacgactcactataggatcggcgcattgaagatggcattccttcattaacaaaccgctgcgcc

SEQ ID NO: 17 - DNA, 42 bp, Artificial Sequence
  Synthetic primer
gatggcattcctccattaacataccgctgcgcccgtagcagc

SEQ ID NO: 18 - DNA, 42 bp, Artificial Sequence
  Synthetic primer
gctgctacgggcgcagcggtatgttaatggaggaatgccatc

SEQ ID NO: 19 - DNA, 41 bp, Artificial Sequence
  Synthetic primer
ggcattcctccattaacaatccgctgcgcccgtagcagctg

SEQ ID NO: 20 - DNA, 41 bp, Artificial Sequence
  Synthetic primer
cagctgctacgggcgcagcggattgttaatggaggaatgcc

SEQ ID NO: 21 - DNA, 40 bp, Artificial Sequence
  Synthetic primer
caggtttctgtaggcatcagcagctgctacgggcgcagcg

SEQ ID NO: 22 - DNA, 39 bp, Artificial Sequence
  Synthetic primer
caggtttctgtaggcatcttcagctgctacgggcgcagc

SEQ ID NO: 23 - DNA, 42 bp, Artificial Sequence
  Synthetic primer
cattggagatggcattcctccactaacaaaccgctgcgcccg

SEQ ID NO: 24 - DNA, 42 bp, Artificial Sequence
  Synthetic primer
cgggcgcagcggtttgttagtggaggaatgccatctccaatg

SEQ ID NO: 25 - DNA, 41 bp, Artificial Sequence
  Synthetic primer
ggagatggcattcctccattcacaaaccgctgcgcccgtag

SEQ ID NO: 26 - DNA, 41 bp, Artificial Sequence
  Synthetic primer
ctacgggcgcagcggtttgtgaatggaggaatgccatctcc

SEQ ID NO: 27 - DNA, 41 bp, Artificial Sequence
  Synthetic primer
gatggcattcctccattaactaaccgctgcgcccgtagcag

SEQ ID NO: 28 - DNA, 41 bp, Artificial Sequence
  Synthetic primer
ctgctacgggcgcagcggttagttaatggaggaatgccatc

SEQ ID NO: 29 - DNA, 52 bp, Artificial Sequence
  Synthetic primer
caggtttctgtaggcatcatcagctgctactggcgcagcggtttgttaatgg

SEQ ID NO: 30 - DNA, 44 bp, Artificial Sequence
  Synthetic primer
gcgcccgtagcagctgatgaaccctacagaaacctgatcaaacc

SEQ ID NO: 31 - DNA, 44 bp, Artificial Sequence
  Synthetic primer
ggtttgatcaggtttctgtagggttcatcagctgctacgggcgc

SEQ ID NO: 32 - DNA, 45 bp, Artificial Sequence
  Synthetic primer
gctaagatcggcgcattggagccggcattcctccattaacaaacc

SEQ ID NO: 33 - DNA, 45 bp, Artificial Sequence
  Synthetic primer
ggtttgttaatggaggaatgccggctccaatgcgccgatcttagc

SEQ ID NO: 34 - DNA, 43 bp, Artificial Sequence
  Synthetic primer
ccgtagcagctgatgatgcccacagaaacctgatcaaaccagg

SEQ ID NO: 35 - DNA, 43 bp, Artificial Sequence
  Synthetic primer
cctggtttgatcaggtttctgtgggcatcatcagctgctacgg

SEQ ID NO: 36 - DNA, 44 bp, Artificial Sequence
  Syntheic primer
aaaccgctgcgcccgtagcagcagatgatgcctacagaaacctg

SEQ ID NO: 37 - DNA, 45 bp, Artificial Sequence
  Synthetic primer
cattcctccattaacaaaccggagcgcccgtagcagctgatgatg

SEQ ID NO: 38 - DNA, 45 bp, Artificial Sequence
  Synthetic primer
catcatcagctgctacgggcgctccggtttgttaatggaggaatg

SEQ ID NO: 39 - DNA, 42 bp, Artificial Sequence
  Synthetic primer
caaaccggagcgcccgtagctcctgatgatgcctacagaaac

SEQ ID NO: 40 - DNA, 42 bp, Artificial Sequence
  Synthetic primer
gtttctgtaggcatcatcaggagctacgggcgctccggtttg

SEQ ID NO: 41 - DNA, 85 bp, Artificial Sequence
  Synthetic primer
  MISC (4)..(9): Restriction site
  MISC (10)..(57): Lysine promoter
aaggaattcaaaaataatgttgtccttttaaataagatctgataaaatgtgaactaaatgtaataattataggcgatggagttcg

SEQ ID NO: 42 - DNA, 44 bp, Artificial Sequence
  Synthetic primer
  MISC (5)..(10): Restriction site
aaggatcccctctttaaatagcttgctcaaaaaaatagactcct

SEQ ID NO: 43 - DNA, 35 bp, Artificial Sequence
  Synthetic primer
  MISC (5)..(10): Restriction site
atgcgaattctttggccctctttcgtaagcggtga

SEQ ID NO: 44 - DNA, 39 bp, Artificial Sequence
  Synthetic primer
  MISC (5)..(10): Restriction site
gacgggatccccaggtcgtcgaaatttagacatttggcc

SEQ ID NO: 45 - DNA, 35 bp, Artificial Sequence
  Synthetic primer
  MISC (5)..(10): Restriction site
gcgaaagctttcatttctcttcccccgcaagagtc

SEQ ID NO: 46 - DNA, 50 bp, Artificial Sequence
  Synthetic primer
ccgcttaatcagcgggttttttttggtctttagtgtgcggttgaggccga

SEQ ID NO: 47 - DNA, 50 bp, Artificial Sequence
  Synthetic primer
cggcgttacacttatcactcatacaaatcaaatagcaggattttgcagtg

SEQ ID NO: 48 - protein, 5 aa, Pseudomonas syringae
GREGT

SEQ ID NO: 49 - protein, 5 aa, Clostridium difficile
GREGV

SEQ ID NO: 50 - protein, 5 aa, Homo sapiens
GSGIP

SEQ ID NO: 51 - protein, 5 aa, Homo sapiens
GKEGP

SEQ ID NO: 52 - protein, 5 aa, Homo sapiens
GGFMP

SEQ ID NO: 53 - protein, 5 aa, Homo sapiens
GLFIP

SEQ ID NO: 54 - protein, 5 aa, Escherichia coli
GIFAP

SEQ ID NO: 55 - protein, 5 aa, Arabidopsis sp.
GPGIP

SEQ ID NO: 56 - protein, 5 aa, Arabidopsis sp.
GIFAP

SEQ ID NO: 57 - protein, 5 aa, Pseudomonas syringae
GNNLI

SEQ ID NO: 58 - protein, 5 aa, Pseudomonas syringae
GEVTP

SEQ ID NO: 59 - protein, 5 aa, Clostridium difficile
GMNLI

SEQ ID NO: 60 - protein, 5 aa, Streptococcus mutans
GMGLI

SEQ ID NO: 61 - protein, 330 aa, Streptococcus pyogenes MGAS10750
AGLVIVFLYDKLGKEVRQGMGLVFQVGHGQKDQIPPILIPLILFSTWVTHLFGASAGREGVAVQIGATISHYCQRFVTSQEAARHLLIMGMAAGFAGLFQTPIAAVVFALEVLLVGTLRYCALLPSLVAACVASWTSHSLGLEKFTIVLEETLTITPLTLKLIGLGLIFGLVGNSFACLLGWFKPYLSQKLPNPYLRIAFIGVLLSICLMIGHVGRYSGLGTHLLAAAFSGQTILTYDWLLKMIVTVISLSAGFQGGEVTPLFAIGASLGIVLAPYLGLPVLLVAALGYVTVFGSATNTFWAPIFIGIEVFGPENALAYFVTSAAAYMIS

SEQ ID NO: 62 - protein, 332 aa, Burkholderia pseudomallei 576
AGFATGWVYHRVGRSVERGNNLLIDEIHDPRAIVPTRMAPLVLVATVVTHLFGGSAGREGTAVQMGGALADRVTQLVGLDRDARRIMLMGGIAAGFSSVFGTPLAGAVFGLEVLAIGRLRYDALFACVAASIVADAVCRLWGVHHTVYVVPFVPAPSAAGVASAVAAGIAFGVVGRLFAAATHGLAALAKRRIAYPPLRPVAGGALVALAATLLHAPQYLGLGIPTIEAAFRAPLPVYDFAGKFAFTVVTLASGFKGGEVTPLFYIGATLGNALSPLLALPAPVLAGLGFVAVFAGAANTPIASTIMAIELFGAPIGVYAALACVVAYLFSG

SEQ ID NO: 63 - protein, 332 aa, Burkholderia pseudomallei K96243; identical to SEQ ID NO: 62

SEQ ID NO: 64 - protein, 332 aa, Burkholderia pseudomallei 112; identical to SEQ ID NO: 62

SEQ ID NO: 65 - protein, 332 aa, Burkholderia mallei JHU; identical to SEQ ID NO: 62

SEQ ID NO: 66 - protein, 332 aa, Burkholderia mallei FMH; identical to SEQ ID NO: 62

SEQ ID NO: 67 - protein, 332 aa, Burkholderia mallei ATCC 10399; identical to SEQ ID NO: 62

SEQ ID NO: 68 - protein, 333 aa, Burkholderia mallei NCTC 10229
MAGFATGWVYHRVGRSVERGNNLLIDEIHDPRAIVPTRMAPLVLVATVVTHLFGGSAGREGTAVQMGGALADRVTQLVGLDRDARRIMLMGGIAAGFSSVFGTPLAGAVFGLEVLAIGRLRYDALFACVAASIVADAVCRLWGVHHTVYVVPFVPAPSAAGVASAVAAGIAFGVVGRLFAAATHGLAALAKRRIAYPPLRPVAGGALVALAATLLHAPQYLGLGIPTIEAAFRAPLPVYDFAGKFAFTVVTLASGFKGGEVTPLFYIGATLGNALSPLLALPAPVLAGLGFVAVFAGAANTPIASTIMAIELFGAPIGVYAALACVVAYLFSG

SEQ ID NO: 69 - protein, 332 aa, Burkholderia pseudomallei 305; identical to SEQ ID NO: 62

SEQ ID NO: 70 - protein, 332 aa, Burkholderia mallei ATCC 23344; identical to SEQ ID NO: 62

SEQ ID NO: 71 - protein, 332 aa, Burkholderia mallei PRL-20; identical to SEQ ID NO: 62

SEQ ID NO: 72 - protein, 332 aa, Burkholderia mallei NCTC 10247; identical to SEQ ID NO: 62

SEQ ID NO: 73 - protein, 332 aa, Burkholderia mallei SAVP1; identical to SEQ ID NO: 62

SEQ ID NO: 74 - protein, 332 aa, Burkholderia pseudomallei 668; identical to SEQ ID NO: 62

SEQ ID NO: 75 - protein, 331 aa, Streptococcus pyogenes SSI-1
AGLVIVFLYDKLGKEVRQGMGLVFQVGHGQKDQIPPILIPLILLSTWVTHLFGASAGREGVAVQIGATISHYCRRFVTSQEAARHLLIMGMAAGFAGLFQTPIAAVVFALEVLLVGTLRYCALLPSLVAACVASWTSHSLGLEKFTIVLEETLTITPLTLVKLIGLGLIFGLVGNSFACLLGWFKPYLSQKLPNPYLRIAFIGVLLSICLMIGRVGRYSGLGTHLIAAAFSGQTILTYDWLLKMIVTVISLSAGFQGGEVTPLFAIGASLGIVLAPYLGLPVLLVAALGYVTVFGSATNTFWAPIFIGIEVFGPENALAYFVTSAAAYMVS

SEQ ID NO: 76 - protein, 331 aa, Streptococcus pyogenes MGAS315; identical to SEQ ID NO: 75

SEQ ID NO: 77 - protein, 332 aa, Burkholderia pseudomallei 1106b
AGFATGWVYHRVGRSVERGNNLLIDEIHDPRAIVPTRMAPLVLVATVVTHLFGGSAGREGTAVQMGGALADRVTQLVGLDRDARRIMLMGGIAAGFSSVFGTPLAGAVFGLEVLAIGRLRYDALFACVAASIVADAVCRLWGVHHTVYVVPFVPAPSAAGVASAVAAGIAFGVVGRLFAAATHGLAALAKRRIAYPPLRPVAGGALVALAATLLHAPQYLGLGIPTIEAAFRAPLPVYDFAGKFAFTVVTLASGFKGGEVTPLFYIGATLGNALSSLLALPAPVLAGLGFVAVFAGAANTPIASTIMAIELFGAPIGVYAALACVVAYLFSG

SEQ ID NO: 78 - protein, 332 aa, Burkholderia pseudomallei 1106a; identical to SEQ ID NO: 77

SEQ ID NO: 79 - protein, 332 aa, Burkholderia pseudomallei 1710b; identical to SEQ ID NO: 77

SEQ ID NO: 80 - protein, 332 aa, Burkholderia pseudomallei 1710a; identical to SEQ ID NO: 77

SEQ ID NO: 81 - protein, 332 aa, Burkholderia pseudomallei Pakistan 9; identical to SEQ ID NO: 77

SEQ ID NO: 82 - protein, 332 aa, Burkholderia pseudomallei 237508459; identical to SEQ ID NO: 77

SEQ ID NO: 83 - protein, 332 aa, Burkholderia pseudomallei DM98; identical to SEQ ID NO: 77

SEQ ID NO: 84 - protein, 332 aa, Burkholderia pseudomallei Pasteur 52237; identical to SEQ ID NO: 77

SEQ ID NO: 85 - protein, 332 aa, Burkholderia pseudomallei 9; identical to SEQ ID NO: 77

SEQ ID NO: 86 - protein, 332 aa, Burkholderia pseudomallei 1655; identical to SEQ ID NO: 77

SEQ ID NO: 87 - protein, 332 aa, Burkholderia pseudomallei B7210; identical to SEQ ID NO: 77

SEQ ID NO: 88 - protein, 332 aa, Burkholderia pseudomallei 14; identical to SEQ ID NO: 77

SEQ ID NO: 89 - protein, 332 aa, Burkholderia thailandensis E264
AGFATGWVYHRVGRSVERGNNLLIDEIHDPQAIVPKRMAPLVLVATVVTHLFGGSAGREGTAVQMGGALADRVTQLVGLERDDRRIMLMGGIAAGFSSVFGTPLAGAVFGLEVLAIGRLRYDALLACVAASIVADAVCRLWGIHHTVYVVPFVPALSAAGVASAVAAGIAFGIVGRLFAAATHALGAFAKRRIAYAPLRPVAGGALVALAATLLHAPQYLGLGIPTIEAAFRAPLPVYDFAGKFAFTVVTLASGFKGGEVTPLFYIGATLGNALSHLLALPVPVLAGLGFVAVFAGAANTPIASTIMAIELFGAPIGVYAALACVVAYLFSG

SEQ ID NO: 90 - protein, 332 aa, Burkholderia thailandensis Bt4; identical to SEQ ID NO: 89

SEQ ID NO: 91 - protein, 332 aa, Burkholderia pseudomallei S13; identical to SEQ ID NO: 77

SEQ ID NO: 92 - protein, 332 aa, Burkholderia pseudomallei NCTC 13177; identical to SEQ ID NO: 77

SEQ ID NO: 93 - protein, 332 aa, Burkholderia pseudomallei 406e; identical to SEQ ID NO: 77

SEQ ID NO: 94 - protein, 332 aa, Burkholderia pseudomallei 406e; identical to SEQ ID NO: 77

SEQ ID NO: 95 - protein, 332 aa, Burkholderia pseudomallei BCC215; identical to SEQ ID NO: 77

SEQ ID NO: 96 - protein, 336 aa, Streptococcus pyogenes MGAS10270
PFLALAGLVIVFLYDKLGKEVRQGMGLVFQVGHGQKDQIPPILIPLILLSTWVTHLFGASAGREGVAVQIGATISHYCRRFVTSQEAARHLLIMGMAAGFAGLFQTPIAAVVFALEVLLVGTLRYCALLPSLVAACVASWTSHSLGLEKFTIVLEETLTITPLTLVKLIGLGLIFGLVGNSFACLLGWFKPYLSQKLPNPYLRIAFIGVLLSICLMIGHVGRYSGLGTHLIAAAFSGQTILTYDWLLKMIVTVISLSAGFQGGEVTPLFAIGASLGIVLAPYLGLPVLLVAALGYVTVFGSAINTFWAPIFIGIEVFGPENALAYFVTSAAAYMVS

SEQ ID NO: 97 - protein, 332 aa, Burkholderia thailandensis E264; identical to SEQ ID NO: 89

SEQ ID NO: 98 - protein, 331 aa, Streptococcus pyogenes MGAS9429
AGLVIVFLYDKLGKEVRQGMGLVFQVGHGQKDQIPPILIPLILFSTWVTHLFGASAGREGVAVQIGATISHYCQRFVTSQEAARHLLIMGMAAGFAGLFQTPIAAVVFALEVLLVGTLRYCALLPSLVAACVASWTSHSLGLEKFTIVLEETLTITPLTLVKLIGLGLIFGLVGNSFAYLLGWFKPYLSQKLPNPYFRIAFIGALLSICLMIGHVGRYSGLGTHLIAAAFSGQTILTYDWLLKMIVTVISLSAGFQGGEVTPLFAIGASLGIVLAPYLGLPVLLVAALGYTTVFGSATNTFWAPIFIGIEVFGPENALAYFVTSAAAYMVS

SEQ ID NO: 99 - protein, 331 aa, Streptococcus pyogenes MGAS6180; identical to SEQ ID NO: 98

SEQ ID NO: 100 - protein, 331 aa, Streptococcus pyogenes MGAS2096
AGLVIVFLYDKLGKEVRQGMGLVFQVGHGQKDQIPPILIPLILFSTWVTHLFGASAGREGVAVQIGATISHYCQRFVTSQEAARHLLIMGMAAGFAGLFQTPIAAVVFALEVLLVGTLPYCALLPSLVAACVASWTSHSLGLEKFTIVLEETLTITPLTLVKLIGLGLIFGLVGNSFAYLLGWFKPYLSQKLPNPYFRIAFIGALLSICLMIGHVGRYSGLGTHLIAAAFSGQTILTYDWLLKMIVTVISLSAGFQGGEVTPLFAIGASLGIVLAPYLGLPVLLVAALGYTTVFGSATNTFWAPIFIGIEVFGPENALAYFVTSAAAYMVS

SEQ ID NO: 101 - protein, 331 aa, Streptococcus pyogenes ATCC 10782
AGLVIVFLYDKLGKEVRQGMGLVFQVGHGQKDQIPPILIPLILFSTWVTHLFGASAGREGVAVQIGATISHYCRRFVTSQEAARHLLIMGMAAGFAGLFQTPIAAVVFALEVLLVGTLRYCALLPSLVAACVASWTSHSLGLEKFTIVLEETLTITPLTLVKLIGLGLIFGLVGNSFACLLGWFKPYLSQKLPNPYLRIAFIGVLLSICLMIGHVGRYSGLGTHLIAAAFSGQTILTYDWLLKMIVTVISLSAGFQGGEVTPLFTIGASLGIILAPYLGLPVLLVAALGYATVFGSATNTFWAPIFIGIEVFGPENALAYFVTSAAAYMVS

SEQ ID NO: 102 - protein, 331 aa, Streptococcus pyogenes MGAS8232; identical to SEQ ID NO: 101

SEQ ID NO: 103 - protein, 331 aa, Streptococcus pyogenes str. Manfredo
AGLVIVFLYDKLGKEVRQGMGLVFEVGHGQKDQIPPILIPLILLSTWVTHLFGASAGREGVAVQIGATISHYCRRFVTSQEAARHLLIMGMAAGFAGLFQTPIAAVVFALEVLLVGTLRYCALLPSLVAACVASWTSHSLGLEKFTIVLEETLTITPLTLVKLIGLGLIFGLVGNSFACLLGWFKPYLSQKLPNPYLRIAFIGVLLSICLMIGHVGRYSGLGTHLIAAAFSGQTILTYDWLLKMIVTVISLSAGFQGGEVTPLFTIGASLGIILAPYLGLPVLLVAALGYATVFGSATNTFWAPIFIGIEVFGPENALAYFVTSAAAYMVS

SEQ ID NO: 104 - protein, 331 aa, Streptococcus pyogenes MGAS5005
AGLVIVFLYDKLGKEVRQGMGLVFQVGHGQKNQIPPILIPLILFSTWVTHLFGASAGREGVAVQIGATISHYCRRFVTSQEAARHLLIMGMAAGFAGLFQTPIAAVVFALEVLLVGTLRYSALLPSLVAAYVASWTSHALGLEKFTIVLEETLTITPLTLVKLIGLGLIFGLVGNSFAYLLGWFKPYLSQKLPNPYFRIAFIGALLSICLMIGHVGRYSGLGTNLIAAAFSGQTILTYDWLLKMIVTVISLSAGFQGGEVTPLFAIGASLGIVLAPYLGLPVLLVAALGYTTVFGSATNTFWAPIFIGIEVFGPENALAYFVTSAAAYMVS

SEQ ID NO: 105 - protein, 331 aa, Streptococcus pyogenes MGAS10394
AGLVIVFLYDKLGKEVRQGMGLVFEVGHGQKDQISPILIPLILFSTWVTHLFGASAGREGVAVQIGATISHYCRRFVTSQEAARHLLIMGMAAGFAGLFQTPIAAVVFALEVLLVGTLRYCALLPSLVAACVASWTSHSLGLEKFTIVLEETLTITPLTLVKLIGLGLIFGLVGNSFAYLLGWFKPYLSQKLPNPYLRIAFIGVLLSICLMIGHVGRYSGLGTHLLAAAFSGQTILTYDWLLKMIVTVISLSAGFQGGEVTPLFAIGASLGIVLAPYLGLPVLLVAALGYTTVFGSATNTFWAPIFIGIEVFGPENALAYFVTSAAAYMVS

SEQ ID NO: 106 - protein, 331 aa, Streptococcus pyogenes NZ131
AGLVIVFLYDKLGKEVRQGMGLVFQVGHGQKNQIPPMLIPLILFSTWVTHLFGASAGREGVAVQIGATISHYCRRFVTSQEAARHLLIMGMAAGFAGLFQTPIAAVVFALEVLLVGTLRYSALLPSLVAAYVASWTSHALGLEKFTIVLEETLTITPLTLVKLIGLGLIFGLVGNSFAYLLGWFKPYLSQKLPNPYFRIAFIGALLSICLMIGHVGRYSGLGTNLIAAAFSGQTILTYDWLLKMIVTVISLSAGFQGGEVTPLFAIGASLGIVLAPYLGLPVLLVAALGYTTVFGSATNTFWAPIFIGIEVFGPENALAYFVTSAAAYMVS

SEQ ID NO: 107 - protein, 331 aa, Streptococcus pyogenes M1 GAS; identical to SEQ ID NO: 106

SEQ ID NO: 108 - protein, 332 aa, Burkholderia oklahomensis EO147
AGFATGWIYHRVGQSVERGNNLLIDEIHDPQRIVPKRMAPLVLAATVVTHLFGGSAGREGTAVQMGGALADRVTQRFRLDRDDRRIMLMSGIAAGFASVFGTPLAGAVFGLEVLAIGRLRYDALLACVAASIVADAVCRLWGIHHTVYAVPFVPALSAAGVASAVAAGIAFGVVGRLFAAATHALGALAKRWIAYPPLRPVAGGALVALAATLLQTPQYLGLGIPTIEAAFRGPLPVYDFAGKFAFTVVTLASGFKGGEVTPLFYIGTTLGNALSHLLALPVPVLAGLGFVAVFAGAANTPIASTIMAIELFGAPIGVYAALACVVAYLFSG

SEQ ID NO: 109 - protein, 332 aa, Burkholderia oklahomensis C6786
AGFATGWIYHRVGQSVERGNNLLIDEIHDPQRIVPKRMAPLVLAATVVTHLFGGSAGREGTAVQMGGALADRVTQRFRLDRDDRRIMLMSGIAAGFASVFGTPLAGAVFGLEVLAIGRLRYDALLACVAASIVADAVCRLWGIHHTVYAVPFVPALSAAGVASAVAAGIAFGVVGRLFAAATHALGALAKRWIAYPPLRPVAGGALVALAATLLQTPQYLGLGIPTIEAAFRGPLPVYDFAGKFAFTVVTLASGFKGGEVTPLFYIGATLGNALSHLLALPVPVLAGLGFVAVFAGAANTPIASTIMAIELFGAPIGVYAALACVVAYLFSG

SEQ ID NO: 110 - protein, 331 aa, Streptococcus dysgalactiae subsp. equisimilis GGS_124
AGLVIVFLYDKLGKEVRQGMGLVFQVGHGQKNQIPPILIPLILFSTWVTHLFGASAGREGVAVQMGATISHYCRRFVTSQEAARHLLIMGMAAGFAGLFQTPIAAVVFALEVLLVGTLRYSALLPSLVAAYVASWTSHALGLEKFTIVLEETLTITPLTLVKLIGLGLIFGLVGNSFAYLLGWFKPYLSQKLPNPYFRIAFIGALLSICLMIGHVGRYSGLGTNLIAAAFSGQTILTYDWLLKMIVTVISLSAGFQGGEVTPLFAIGASLGLVLAPYLGLPVLLVAALGYATVFGSATNTFWAPIFIGMEVFGPDNALAYFVTAAAAYMVS

SEQ ID NO: 111 - protein, 332 aa, Xanthomonas campestris pv. campestris str. 8004
AGFGVGLVYHLLGKDVDAGNNLIIDEIHDPRKTLPLRMAPLVLGGTVISHLFGASVGREGTAVQMGAALADQLTRVFRLLQQDRRLLLMAGISAGFASVFGTPLAGAIFGLEVLVIGRLRYDALLPCTMAAIVANQVCLAWGIQHTHYAIERIVPVGVGSVLAVMAAGVVFGLVGRLFATATHLLGQSVKQAIAYAPLRPLLGGVVIALAVWLLGTQRYIGLGIPEIVRAFHEPMEPWDFLGKACFTVASLATGFKGGEVTPLFYIGATLGNALAPLLQLPFSMLAGLGLVAVFAGASNTPIASTLMAVELFGADIASFAAVACITAYLFSG

SEQ ID NO: 112 - protein, 332 aa, Xanthomonas campestris pv. campestris str. ATCC 33913; identical to SEQ ID NO: 111

SEQ ID NO: 113 - protein, 332 aa, Xanthomonas campestris pv. campestris str. B100; identical to SEQ ID NO: 111

SEQ ID NO: 114 - protein, 332 aa, Burkholderia multivorans CGD1
AGFATGWVYHRFGQPVARGNNLLIDEIHDPKALVPKRMAPLVLVATVVTHLFGGSAGREGTAVQMGGALADRVTHAFRLDREHRRVLLMGGIAAGFSSVFGTPLAGAVFGLEVLAIGRLRYDALLACVASAIVADVVCRAWGVHHTVYAVPFVPAVSAAGLAATVVAGIAFGVVGRLFAHATHALAAGFRRAIRYAPLQPVLGGVLVAAAATALNVPQYLGLGIPTIEAAFRGPLPVYDFAGKFAFTVVTLASGFKGGEVTPLFYIGATLGNALGQVLALPVPVLAALGFVAVFAGAANTPIASTIMAIELFGADIGVYAIVACVVAYLFSG

SEQ ID NO: 115 - protein, 332 aa, Burkholderia multivorans ATCC 17616
AGFATGWVYHRFGQPVARGNNLLIDEIHDPKALVPKRMAPLVLVATVVTHLFGGSAGREGTAVQMGGALADRVTHAFRLDREHRRVLLMGGIAAGFSSVFGTPLAGAVFGLEVLAIGRLRYDALLACVASAIVADVVCRAWGVHHTVYAVPFVPAVSAAGLAATVVAGIAFGVVGRLFAHATHALAAGFRRTIRYAPLQPVLGGVLVAAAATALNVPQYLGLGIPTIEAAFRGPLPVYDFAGKFAFTVVTLASGFKGGEVTPLFYIGATLGNALGQVLALPVPVLAALGFVAVFAGAANTPIASTIMAIELFGADIGVYAIVACVVAYLFSG

SEQ ID NO: 116 - protein, 332 aa, Burkholderia multivorans ATCC 17616; identical to SEQ ID NO: 115

SEQ ID NO: 117 - protein, 332 aa, Burkholderia multivorans CGD2
AGFATGWVYHRFGQPVARGNNLLIDEIHDPRALVPKRMAPLVLAATVVTHLFGGSAGREGTAVQMGGALADRVTHAFRLDREHRRVLLMGGIAAGFSSVFGTPLAGAVFGLEVLAIGRLRYDALLACVASAIVADVVCRAWGVHHTVYAVPFVPAVSAAGLAATVVAGIAFGAVGRLFAHATHALAAGFRRAIRYAPLQPVLGGVLVAAAATALNVPQYLGLGIPTIEAAFRGPLPVYDFAGKFAFTVVTLASGFKGGEVTPLFYIGATLGNALGHVLALPVPVLAALGFVAVFAGAANTPIASTIMAIELFGADIGVYAIVACVVAYLFSG

SEQ ID NO: 118 - protein, 332 aa, Burkholderia multivorans CGD2M; identical to SEQ ID NO: 117

SEQ ID NO: 119 - protein, 330 aa, Streptococcus agalactiae COH1
  misc_feature (131)..(131): Xaa can be any naturally occurring amino acid
GLFIVFVYQKFGGKSVKGMGLVFEVGHGNEETIPKRLVPLVILTTWLTHLFGGSAGREGVAVQIGATVSHYFQKYCRLQNASQLFLVMGMAAGFAGLFQTPLAATFFAIEVLVVGRLMVSYILPSLIAALXANFVSHSLGLEKFSHSIATSMALTPDIILKLLVLGLCFGLCGNLFAYLLAKAKLIASSRLLNPYKRIFTLGLLATFLLFIFHFGRYSGLGTNLIEASFTNKNLYDYDWLLKLCLTVITLAAGYQGGEVTPLFAIGASLGVIIAPILGLPVILVAALGYTSVFGSATNTLLGPILIGGEVFGFANTPYFVIVCLVAYSIS

SEQ ID NO: 120 - protein, 332 aa, Burkholderia ubonensis Bu
AGFATCWIYHRFGQSVARGNNLLIDEIHDPKALVPKRMAPLVLVATVVTHLFGGSAGREGTAVQMGGALADRVTHALRLDREHRRVLLMAGIAAGFASVFGTPLAGAVFGLEVLAIGRVRYDALLACVASAIVADVVCRLWGVHHTAYAIPFVPPVSAAGLGATVVAGIAFGVVGRLFAHATHALSALFRRRIRYAPLQPVVGGLLVAVAATALNVPRYLGLGIPTIEAAFHGPLPAYDFAGKFAFTVVTLASGFKGGEVTPLFYIGATLGNALGQVLALPVPVLAGLGFVAVFAGAANTPVASTIMAIELFGADIGVHAIVACVVAYLFSG

SEQ ID NO: 121 - protein, 330 aa, Streptococcus agalactiae CJB111
GLFIVFVYQKFGGKSVKGMGLVFEVGHGNEETIPKRLVPLVILTTWLTHLFGGSAGREGVAVQIGATVSHYFQKYCRLQNASQLFLVMGMAAGFAGLFQTPLAATFFAIEVLVVGRLMVSYVLPSLIAALTANFVSHSLGLEKFSHSIATSMALTPDIILKLLVLGLCFGLCGNLFAYLLAKAKLIASSRLLNPYKRIFTLGLLATFLLFIFHFGRYSGLGTNLIEASFTNKNLYDYDWLLKLCLTVITLAAGYQGGEVTPLFAIGASLGVIIAPILGLPVILVAALGYTSVFGSATNTLLGPILIGGEVFGFANTPYFVIVCLVAYSIS

SEQ ID NO: 122 - protein, 330 aa, Streptococcus agalactiae 18RS21; identical to SEQ ID NO: 121

SEQ ID NO: 123 - protein, 330 aa, Streptococcus agalactiae A909; identical to SEQ ID NO: 121

SEQ ID NO: 124 - protein, 330 aa, Streptococcus agalactiae NEM316; identical to SEQ ID NO: 121

SEQ ID NO: 125 - protein, 330 aa, Streptococcus agalactiae 2603V/R; identical to SEQ ID NO: 121

SEQ ID NO: 126 - protein, 332 aa, Burkholderia ambifaria IOP40-10
AGFATGWVYHRFGQSVARGNNLLIDEIHDPKALVPKRMAPLVLVATVVTHLFGGSAGREGTAVQMGGALADRVTHLFRLDREHRRVLLMGGIAAGFSSVFGTPLAGAVFGLEVLAIGRLRYDALLTCVASAIVADVVCRAWGVHHTAYAIPFVPAVSATGLAATVVAGVAFGVVGRLFAFATHALTAWFRRVVRHATLQPVLGGAIVAVAATVLNVPQYLGLGIPTIEAAFHGPLPAYDFAGKFAFTVVTLASGFKGGEVTPLFYIGATLGNALGQVLALPMPVLAGLGFVAVFAGAANTPIASTIMAIELFGADVGVYAIVACVVAYLFSG

SEQ ID NO: 127 - protein, 332 aa, Burkholderia vietnamiensis G4
AGFATGWVYHRFGQSVARGNNLLIDEIHDPKALVPKRMGPLVLAATVVTHLFGGSAGREGTAVQMGGALADRVTQLFRLDREHRRVLLMGGIAAGFSSVFGTPLAGAVFGLEVLAIGRLRYDALLTCVASSIVADVVCRAWGVHHTVYAIASVPAVSATGLAATVVAGVAFGVVGRLFAFATHALTAWFRRVVRYAPLQPVLGGAMVAVAATVLNVPQYLGLGIPTIEAAFHGPLPAYDFAGKFAFTVVTLASGFKGGEVTPLFYIGATLGNALGQVLALPVPVLAGLGFVAVFAGAANTPIASTIMAIELFGADLGVYAIVACVVAYLFSG

SEQ ID NO: 128 - protein, 332 aa, Burkholderia ambifaria AMMD
AGFATGWVYHRFGQSVARGNNLLIDEIHDPKALVPKRMAPLVLVATVVTHLFGGSAGREGTAVQMGGALADRVTHLFRLDREHRRVLLMGGIAAGFSSVFGTPLAGAVFGLEVLAIGRVRYDALLTCVASAIVADVVCRAWGVHHTVYAIPFVPAVSATGLAATVVAGVAFGVVGRLFAFATHALTAWFRRVVRHAPLQPVLGGAIVAVAATVLNVPQYLGLGIPTIEAAFHGPLPAYDFAGKFVFTVVTLASGFKGGEVTPLFYIGATLGNALGQVLALPVPVLAGLGFVAVFAGAANTPIASTIMAIELFGADVGVYAIVACVVAYLFSG

SEQ ID NO: 129 - protein, 332 aa, Burkholderia ambifaria MC40-6
AGFATGWVYHRFGQSVARGNNLLIDEIHDPKALVPKRMAPLVLVATVVTHLFGGSAGREGTAVQMGGALADRVTHLFRLDREHRRVLLMGGIAAGFSSVFGTPLAGAVFGLEVLAIGRVRYDALLTCVASAIVADVVCRAWGVHHTVYAIPFVPAVSATGLAATVVAGVAFGVVGRLFAFATHALTGWFRRVVRHAPLQPVLGGAIVAVAATVLNVPQYLGLGIPTIEAAFHGPLPAYDFAGKFAFTVVTLASGFKGGEVTPLFYIGATLGNALGQVLALPVPVLAGLGFVAVFAGAANTPIASTIMAIELFGADVGVYAIVACVVAYLFSG

SEQ ID NO: 130 - protein, 332 aa, Burkholderia cenocepacia MC0-3
AGFATGWVYHRFGQSVARGNNLLIDEIHDPKALVPKRMAPLVLVATVVTHLFGGSAGREGTAVQMGGALADRITHVLRLDREHRRVLLMGGIAAGFASVFGTPLAGAVFGLEVLAIGRLRYDALLTCVASAIVADVVCRAWGVHHTAYAIPFVPAVSATGLAVTVVAGIAFGVVGRLFAFATHVLTAWFRRVIRHAPLQPVVGGLLVAVAATMLNVPQYLGLGIPTIEAAFHGPLPLYDFAGKFAFTVVTLASGFKGGEVTPLFYIGATLGNALGQVLALPVPVLAGLGFVAVFAGAANTPIASTIMAIELFGADIGVYAIVACVVAYLFSG

SEQ ID NO: 131 - protein, 332 aa, Burkholderia cenocepacia PC184
AGFATGWVYHRFGQSVARGNNLLIDEIHDPKALVPKRMAPLVLVATVVTHLFGGSAGREGTAVQMGGALADRITHVLRLDREHRRVLLMGGIAAGFASVFGTPLAGAVFGLEVLAIGRLRYDALLTCVASAIVADVVCRAWGVHHTAYAIPFVPAVSATGLAVTVVAGIAFGVVGRLFAFATHALTAWFRRVIRHAPLQPVVGGLLVAVAATVLNVPQYLGLGIPTIEAAFHGPLPLYDFAGKFAFTVVTLASGFKGGEVTPLFYIGATLGNALGQVLALPVPVLAGLGFVAVFAGAANTPIASTIMAIELFGADIGVYAIVACVVAYLFSG

SEQ ID NO: 132 - protein, 332 aa, Burkholderia cenocepacia J2315
AGFATGWVYHRFGQSVARGNNLLIDEIHDPKALVPKRMAPLVLVATVVTHLFGGSAGREGTAVQMGGALADRVTHVFRLDREHRRVLLMGGIAAGFASVFGTPLAGAVFGLEVLAIGRVRYDALLTCVASAIVADVVCRAWGVHHTAYAIPFVPAVSATGLAVTVVAGIAFGVVGRLFAFATHALTAWFRRVIRYAPLQPVLGGLMVAVAATVLNVPQYLGLGIPTIEAAFHGPLPLYDFAGKFAFTVVTLASGFKGGEVTPLFYIGATLGNALGQVLALPAPVLAGLGFVAVFAGAANTPIASTIMAIELFGADIGVYAIVACVVAYLFSG

SEQ ID NO: 133 - protein, 332 aa, Burkholderia cenocepacia HI2424
AGFATGWVYHRFGQSVARGNNLLIDEIHDPKALVPKRMAPLVLVATVVTHLFGGSAGREGTAVQMGGALADRITHVLRLDREHRRVLLMGGIAAGFASVFGTPLAGAVFGLEVLAIGRLRYDALLTCVASAIVADVVCRAWGVHHTAYAIPFVPAVSATGLAVTVVAGIAFGVVGRLFAFATHALTAWFRRVIRHAPLQPVLGGLLVAVAATVLNVPQYLGLGIPTIEAAFHGPLPLYDFAGKFAFTVVTLASGFKGGEVTPLFYIGATLGNALGQVLALPVPVLAGLGFVAVFAGAANTPIASTIMAIELFGADIGVYAIVACVVAYLFSG

SEQ ID NO: 134 - protein, 332 aa, Burkholderia cenocepacia AU 1054; identical to SEQ ID NO: 133

SEQ ID NO: 135 - protein, 332 aa, Burkholderia sp. 383
AGFATGWIYHRFGQSVARGNNLLIDEIHDPKALVPKRMAPLVLVATVVTHLFGGSAGREGTAVQMGGALADRITHVFRLDREHRRVLLMGGIAAGFASVFGTPLAGAVFGLEVLAIGRVRYDALLTCVASAIVADVVCRAWGVHHTAYAIPFVPAVSATGLAVTVVAGIAFGVVGRLFAFATHALTAWFRRVVRYAPLQPVLGGLLVAAAATALNVPQYLGLGIPTIEAAFHGPLPLYDFAGKFAFTVVTLASGFKGGEVTPLFYIGATLGNALGQVLALPVPVLAGLGFVAVFAGAANTPIASTIMAIELFGADIGVYAIVACVVAYLFSG

SEQ ID NO: 136 - protein, 332 aa, Pseudogulbenkiania ferrooxidans 2002
AGFGVGWLYLRFGQRVEAGNNLLIDEIHDPKRVIPLRMAPLVLGGTVLSHLFGASVGREGTAVQMGGALADQFTHLFKLRHEDRRIILMAGISAGFASVFGTPLAGAIFGLEVLAIGRLRYDAILPCMVAAIVADQVGLLWGVHHTRYVIPFIPPLSAWGLAATVIAGMLFGLTGKVFADLTHGLGGWIKQRIGYAPLRPLLGGMVIAAAVYLLGADRYIGLGVPTIVEAFQQPLAPYDFAAKMAFTVASLGSGFKGGEVTPLFYIGATLGNALAPLLGMPLPLLAGIGFVAVFAGAANTPIASTLMAMELFGSEIGVYASIACVVSYLFSG

SEQ ID NO: 137 - protein, 332 aa, Ralstonia solanacearum CFBP2957
AGLAVGLLYHYAGRSVEGGNNLLIDEIHDPKRIVPKRMAPLILLGTVVTHLFGGSAGREGTAVQMGGSFADYLTRLFRLDQSDRRILLMSGISAGFASVFGTPLAGAVFGLEVLAIGRLRYDAILPCFVAAIVGDLVPPLLGVHHTPYVIPFVPHLTPLAIGAAVVAGIVFGVAGMTFAELTHRLSRALKQRIPFGPLRPLLGGGVVAAASMALGTDRYLGLGIPTIVEAFHNPLPAYDFAGKIAFTVVTLSSGFKGGEVTPLFYIGATLGNALGYVLPLPFPLLAGLGFVAVFAGAANTPIASTIMAIELFGPEVGTFAGMACVVSYLFSG

SEQ ID NO: 138 - protein, 332 aa, Burkholderia phytofirmans PsJN
AGFATGWVYHRVGKPVEGGNNLLIDEIHDPQKIVPKRMAPLVLIATVVTHLFGGSAGREGTAVQMGGALADQVTKLFGLEREDRRILLMGGIAAGFSSVFGTPLAGAIFGLEVLSIGRLRYDALLTCVASSLVANQVCRVWGIHHTVYTIPFVPHVSPLGLGSVILAGIAFGVVGMLFADSTHALSAFIKRQIAYAPARPFVGGLVVALAATVLNVPQYLGLGIPTIVESFNQSLPVYDFAGKFGFTVVTLASGFKGGEVTPLFYIGATLGNALGHVLALPMPVLAGLGFVAVFAGAANTPIASTVMAIELFGADIGMYAALACVVAYLFSG

SEQ ID NO: 139 - protein, 332 aa, tia acidovorans SPH-1
AGMAVGLVYFLLGKRVDGGNNLLIEEIHDPKQVVPLRMVPLVLGGTVISHLFGASVGREGTAVQMGGALADQLTHVFRLHQDDRRVLLMSGISAGFASVFGTPLAGAVFGLEVLAIGRMRYDALFPCIVAAFVADQVCTAWGVHHTHYAMSAVNNIDAWSVVAVIIAGILFGLVGMLFATAVHKIGALVKHLIAYPPLRPFFGGLVIATAVWALDAYRYIGLGIPDIARSFQEPMLPWDFLGKLVFTVASLGTGFKGGEVTPLFYIGATMGNVLAPLLHMPFALMAAIGFVAVFAGAANTPIATTLMAMELFGAGIGPLAAIGCVTAYLFSG

SEQ ID NO: 140 - protein, 332 aa, Ralstonia solanacearum IPO1609
AGLAVGLLYHYAGRSVEGGNNLLIDEIHDPKRIVPKRMAPLILLGTVVTHLFGGSAGREGTAVQMGGSFADYLTRLFHLDQGDRRILLMSGISAGFASVFGTPLAGAVFGLEVLAIGRLRYDAILPCFVAAIVGDLVPPLLGVHHTPYVIPFVPHLTPLAISAAVVAGIVFGVAGMTFAELTHRLSRALKQRIPFGPLRPLLGGGVVAAASMALGTDRYLGLGIPTIVEAFHNPLPAYDFAGKIAFTVVTLSSGFKGGEVTPLFYIGATLGNALGYVLPLPFPLLAGLGFVAVFAGAANTPIASTIMAIELFGPEVGTFAGMACVVSYLFSG

SEQ ID NO: 141 - protein, 332 aa, Herbaspirillum seropedicae SmR1
GGFAVGWLYLHTGKPVEAGNNLLIDEIHDPRKVIPLRMAPLVLLGTVASHLFGASVGREGTAVQMGGALADQLTHLLRLRPEDRRILLMAGISAGFSSVFGTPMAGAIFGLEVLAIGRMRYEAIFPCFVAAIAADQVGLAWGVHHTHYAMNASAPMALWSVAAVIAAGVVFGLAGMIFANSTHTLSAFMKRHVSYAPLRPFIGGFIVALAVWAVGTHRYIGLGIPVIVEAFQQPLAPWDFLGKMVFTVTSLGSGFKGGEVTPLFYIGATLGNALAPLLHLPFPLLAGIGFVAVFAGAANTPLASTIMAIELFGPQIGPFAALACVVAYLFSG

SEQ ID NO: 142 - protein, 332 aa, Ralstonia solanacearum UW551; identical to SEQ ID NO: 140

SEQ ID NO: 143 - protein, 332 aa, Ralstonia solanacearum GMI1000
AGLAVGLLYHYTGRAVEGGNNLLIDEIHDPKRVVPKRMAPLILLGTVVTHLFGGSAGREGTAVQMGGSFADGLTRLFRLDNEARRILLMSGISAGFASVFGTPLAGAVFGLEVLAIGRLRYDAILPCFVAAIVGDLVPPLLGVHHTPYAIPFVPHLTPLAIGAVVVAGIVFGLAGMTFAELTHRLGRWLKKRIPFGPLRPVLGGCVVAAAATALGTDKYLGLGIPVIVDAFHQPLPAYDFAGKAAFTIVTLASGFKGGEVTPLFYIGATLGNALGYVLPLPFALLAGLGFVAVFAGAANTPIASTIMAIELFGPEVGTFAGIACVVSYLFSG

SEQ ID NO: 144 - protein, 332 aa, Ralstonia solanacearum MolK2
AGLAVGLLYHYAGRSVEGGNNLLIDEIHDPKRIVPKRMAPLILLGTVVTHLFGGSAGREGTAVQMGGSFADYLTRLFHLDQGDRRILLMSGISAGFASVFGTPLAGAVFGLEVLAIGRLRYDAILPCFVAAIVGDLVPPLLGVHHTPYVIPFVPHLTPLAIGAAVVAGIVFGVAGMTFAELTHRLSRALKQRIPFGPLRPLLGGGVVAAASMALGTDRYLGLGIPTIVEAFHNPLPAYDFAGKIAFTVVTLSSGFKGGEVTPLFYIGATLGNALGYVLPLPFPLLAGLGFVAVFAGAANTPIASTIMAIELFGPEVGTFAGMACVVSYLFSG

SEQ ID NO: 145 - protein, 332 aa, Xanthomonas oryzae pv. oryzicola BLS256
AGFAVGLVYLLLGKQVDAGNNLIIDEIHDPKKLVPLRMAPLVMGSTVVSHLFGASVGREGTAVQMGAALADQLTRLLRLRNEDRRMVLMAGISAGFASVFGTPLAGAIFGLEVLAIGRLRYDALLPCAVAAIVADQVCLAWGIHHIHDPIGQIVPVGIGSVLAVMAAGMLFGLVGMLFATVTHRLGNVSKRAIGYAPLRPLLGGCIIALAVWGLGTQRYIGLGIPAIVRAFHEPMAPWDFLGKLCFTAVSLGTGFKGGEVTPLFYIGATLGNALAPLLHLPFPMLAGIGFVAVFAGASNTPIASTLMAVELFGADIAPLAAIGCITAYLFSG

SEQ ID NO: 146 - protein, 332 aa, Xanthomonas oryzae pv. oryzae MAFF 311018
AGFAVGLVYLLLGKQVDAGNNLIIDEIQDPKKLVPLRMAPLVMGGTVVSHLFGASVGREGTAVQMGAALADQLTRLLRLRNEDRRMVLMAGISAGFASVFGTPLAGAIFGLEVLAIGRLRYDALLPCAVAAIVADQVCLAWGIHHIHYPIGQIVPVGIGSVLAVMAAGMLFGLVGMLFATVTHRLGNVSKRAIGYAPLRLLLGGCIIALAVWGLGTQRYIGLGIPEIVRAFHEPMAPWDFLGKLCFTAVSLGTGFKGGEVTPLFYIGATLGNALAPLLHLPFPMLAGIGFVALFAGASNTPIASTLMAVELFGADIAPLAAIGCITAYLFSG

SEQ ID NO: 147 - protein, 332 aa, nas oryzae pv. oryzae KACC 10331; identical to SEQ ID NO: 146

SEQ ID NO: 148 - protein, 332 aa, Xanthomonas oryzae pv. oryzae PXO99A; identical to SEQ ID NO: 146

SEQ ID NO: 149 - protein, 332 aa, Xanthomonas oryzae pv. oryzae PXO99A; identical to SEQ ID NO: 146

SEQ ID NO: 150 - protein, 332 aa, Citrobacter sp. 30_2
AGLLVGLVYSWYGEPVNAGNNLIIDEIHDPRKVVPIRMVPLVLGGTLMSHLFGASVGREGTAVQMGGALADQLTHMFKVKKDARRILLMAGMSAGFSSVFGTPMAGAIFGMEVLAIGRIRYDALFPCLVAAVLADQVCLAWGVHHTHYRIDFIPAFTIWSFLSVVIAGAVFGLAGMVFSVATGKASGIVKRYIKYAPLRPFFGGILIAAAVWFIGTDRYIGLGIPEIVRAFKEPLYPMDFMGKMSFTIVSLATGFKGGEVTPLFYIGATLGNALAPLLHMPFAFMAGIGFVAVFAGAANTPLATTFMAMELFGTEMAVFSAVGCFTAYLFSG

SEQ ID NO: 151 - protein, 332 aa, Chromobacterium violaceum ATCC 12472
GGFAVGMAYLRLGKEVEGGNNLLIDEIHDPQKTVPLRMVPLVLTGTVVTHLFGGSAGREGTAVQMGGALADQVHKVLPLQPEDRRMLLMAGISVGFASVFGTPLAGAIFGLEMLAIGRLRYDAILPCLAAAILGDQASLLWGVHHTFYRIPFIPALDAWGLCASVLAGAAFGLTGKLFAESVHWLADCLRRRIAFAPLRPLIGGGAIAVAASLMDARAYLGLGIPTLVSAFQQPLSPYDVIGKLGFTVATLGSGFKGGEVTPLFYIGAALGNMLAPLLHLPFPLLAGMGFVAVFAGAANTPLASTVMALELFGSEIGVYAGMACVVAYLFSG

SEQ ID NO: 152 - protein, 332 aa, Xanthomonas albilineans GPE PC73
AGFGVGLVYHLLGKVVDGGNNLIIEEIHDPKQVVPLRMAPLVLGGTVVSHLFGASVGREGTAVQMGAALADQLTHVLRMRRQDRRILLMAGISAGFASVFGTPLAGAVFGLEVLAIGRMRYDALFPCILAALIADQTCLAWGVHHTPYAIGQSVPVSVGSVISVVAAGIVFGLIGMLFATATHRFGAVVKRAIGYAPLRPAIGGIVIATAVWILDAYHYVGLGIPDIVRSFQQPLPSWDFFGKFVFTVMSLGTGFKGGEVTPLFYIGATLGNALAPLLHLPFSLLAGIGFVAVFSGAANTPIATTLMAMELFGADIGPLAAIGCVTAYLFSG

SEQ ID NO: 153 - protein, 338 aa, Pseudomonas syringae pv. syringae B728a
AGFAVGLAYHLIGKPVDAGNNLIIDEIHDPKKIVPLRMVPMVLIGTVVSHLFGASVGREGTAVQMGGALADQLTHVFRLRREDRRVILMAGISAGFASVFGTPLAGALFGLEVLAIGRMRYDALFPCVVAAIVADQVGQAWGVVHTHYVIGEVVPVQLWSVMAVVAAGIVFGLTGLLFATATHKLGAFVKRLITYSPLRPFAGGLLIAVAVWALGSNHYIDVDKYIGLGIPSIVQSFQMPMAPWDWLGKMVFTVVSLGTGFKGGEVTPLFYIGATLGNALAPLLHLPFGMLAGIGFVAVFAGAANTPLATIVMAMELFGPEIAPLAAIACIASYLVSG

SEQ ID NO: 154 - protein, 338 aa, Pseudomonas syringae pv. tomato T1
AGFAVGLAYHLIGKPVDAGNNLIIDEIHDPKKIVPLRMVPMVLIGTVVSHLFGASVGREGTAVQMGGALADQLTHIFRLRREDRRVILMAGISAGFASVFGTPLAGALFGLEVLAIGRMRYDALFPCVVAAIVADQVGQAWGVVHTHYVIGEVVPVQLWSVMAVVAAGIVFGLTGLLFATATHKLGAFVKRLITYSPLRPFAGGLLIAVAVWALGSNHYIDVDKYIGLGIPSIVQSFQMPMAPWDWLGKMVFTVVSLGTGFKGGEVTPLFYIGATLGNALAPLLHLPFGMLAGIGFVAVFAGAANTPLATIVMAMELFGPEIAPLAAIACIASYLVSG

SEQ ID NO: 155 - protein, 332 aa, Leptothrix cholodnii SP-6
AGFAVGWVYLKVGRGVEAGNNLLIDEIHDPKNVVPLRMAPLILAGTVISHLFGASVGREGTAVQMGGALADQLTHVFKLRPEDRRILLMAGISAGFASVFGTPLAGAVFGLEVLLIGRLRYDALLPCFTAAIVADQVTTAWGVHHTHYLAGLIPAVSAWTLTAVVLAGIVFGLVGMLFAQATHAGAAVVRRHVGYPPLRPLFGGAAIAVVIWFGDGWRYAGLGIPVIVEAFVQPVPSWDFAAKLGLTVASLASGFKGGEVTPLFFIGATLGNALAPLLQLPLGLLAALGFVAVFAGAANTPLACTLMAMELFGAQIGVYAGLACVVSYLFSG

SEQ ID NO: 156 - protein, 377 aa, Burkholderia glumae BGR1
AGFATGWFYLRFGSAVEGGNNLLIDEIHDPARAVPTRMAPLVMLATVVTHLFGGSAGREGTAVQMGGALAERLARLLRVQAETRRILLMAGIAAGFSSVFGTPLAGAVFGLEVLAIGRLRYDALLPCVAAAIVAAGIAAGFSSVFGTPLAGAVFGLEVLAIGRLRYDALLPCVAAAIVADAVCRWWGIHHPLYPVPFVPALSLATAASAIIAGLAFGVVGMLFADATHALGARFKRWIPYAPLRPVAGGALVALAGGALAVPQYLGLGIPTIEAAFRGPLPVYEFAGKFAFTLVTLASGFKGGEVTPLFYIGATLGNALSHLLALPLPVLAGLGFVAVFAGAANTPIASTIMAIELFGAPIGVFAALACVVAYLFSG

SEQ ID NO: 157 - protein, 338 aa, Pseudomonas fluorescens SBW25
AGFAVGLAYHLIGKPVDAGNNLIIDEIHDPKKTIPLRMVPMVLIGTVVSHLFGASVGREGTAVQMGGALADQLTHVFRLRREDRRVILMAGISAGFASVFGTPLAGALFGLEVLAIGRMRYDALFPCVVAAIVADQVGKAWGVVHTHYVIGEVVPVQLWSVMAVVAAGIIFGLTGLLFATTTHKLGAFVKRLISYSPLRPFAGGLLIAVAVWALGSNHYTDVDKYIGLGIPSIVQSFQMPMAPWDWLGKMLFTVVSLGTGFKGGEVTPLFYIGATLGNALAPLLHLPFGMLAGIGFVAVFAGAANTPLATIVMAMELFGPEIAPLAAIACIASYLVSG

SEQ ID NO: 158 - protein, 332 aa, Ralstonia solanacearum PSI07
AGLAVGLLYHYTGHAVEGGNNLLIDEIHDPKRIVPKRMAPLILLGTVVTHLFGGSAGREGTAVQMGGSFADDLTRLFRLDKNNRRILLMSGISAGFASVFGTPLAGAVFGLEVLAIGQLRYDAILPCFVAAIVGDLVPPLLGVHHTPYAIPFVPHLTPLAIGAVVVAGIVFGLAGMTFAELTHRTGRALKKRIPFGPLRPVLGGCVVAAAGMALGTDKYLGLGIQTIVDAFHHPLPAYDFAGKIAFTVVTLSSGFKGGEVTPLFYIGATLGNALGYVLPLPFPLLAGLGFVAVFAGAANTPIASTIMAIELFGPEVGTFAGIACVVSYLFSG

SEQ ID NO: 159 - protein, 338 aa, Pseudomonas syringae pv. tomato str. DC3000; identical to SEQ ID NO: 153

SEQ ID NO: 160 - protein, 338 aa, Pseudomonas syringae pv. oryzae str. 1_6
AGFAVGLAYHLIGKPVDAGNNLIIDEIHDPKKIVPLRMVPMVLIGTVVSHLFGASVGREGTAVQMGGALADQLTHVFRLRREDRRVILMAGISAGFASVFGTPLAGALFGLEVLAIGRMRYDALFPCVVAAIVADQVGQAWGVVHTHYVIGEVVPVQLWSVMAVVAAGIVFGLTGLLFATATHKLGAFVKRLITYSPLRPFAGGLLIAVVVWALGSNHYIDVDKYIGLGIPSIVQSFQMPMAPWDWLGKMVFTVVSLGTGFKGGEVTPLFYIGATLGNALAPLLHLPFGMLAGIGFVAVFAGAANTPLATIVMAMELFGPEIAPLAAIACIASYLVSG

SEQ ID NO: 161 - protein, 332 aa, Ralstonia pickettii 12D
AGLAVGLLYHYTGRSVEGGNNLLIDEIHDPKRVVPKRMAPLILLSTVVTHIFGGSAGREGTAVQMGGSFADYLTRLFSLAPADRRILLMAGISAGFASVFGTPLAGAVFGLEVLAIGRLRYDAILPCFIAAIVGDLVPPLLGVHHTPYAIPFVPHLTPVAIGLVVVAGIVFGLAGMTFAALTHRLSRLLKRHIAFGPLRPVLGGSVVVAAALALGTDKYLGLGIPVIVDTFHNPLPAYDFAGKAAFTIVTLASGFKGGEVTPLFYIGATLGNALGYVLPLPFPLLAGLGFVAVFAGAANTPIASTLMAMELFGPEVGTFAGIACVVSYLFSG

SEQ ID NO: 162 - protein, 332 aa, Ralstonia pickettii 12J; identical to SEQ ID NO: 161

SEQ ID NO: 163 - protein, 338 aa, Pseudomonas syringae pv. tomato K40; identical to SEQ ID NO: 154

SEQ ID NO: 164 - protein, 332 aa, Ralstonia sp. 5_7_47FAA
AGLAVGLLYHYTGRSVEGGNNLLIDEIHDPKRIVPKRVAPLILLGTVVTHIFGGSAGREGTAVQMGGSFADYLTRLFSLAPADRRILLMAGISAGFASVFGTPLAGAVFGLEVLAIGSLRYDAILPCFIAAIMGDLVPPLLGVHHTPYAIPFVPHLTPIAIGLVVVAGIVFGLAGMTFAALTHRLSRLLKHHIAFGPLRPVLGGSVVVAAALALGTDKYLGLGIPVIVDAFHTPLPAYDFAGKAAFTIVTLASGFKGGEVTPLFYIGATLGNALGYVLPLPFPLLAGLGFVAVFAGAANTPIASTLMAMELFGPEVGTFAGIACVVSYLFSG

SEQ ID NO: 165 - protein, 329 aa, Clostridium difficile 630
GVVIAYCYFKFGGKSSKGMNLIFEVGHGEEEIIPLRLVPFIISGTWLTHLFGGSAGREGVAVQIGATFSHWVGKRLPIKNASSIFLVTGMAAGFAGLFETPIAAILFAMEVLVAGSLEYQSLFPAFTASFTASAVSKALGLEKFSFALSSKVVFDLSIFWKLIVLGIIFGMVGGAFAWCLKLSKRKIGNRLKNPMIRIAIIGVCLSVLFLLFYKGRYSGLGTNLIQNSFYGGEIYSFDWLLKFILTILTLSAGFQGGEVTPLFSIGASLGVLLAGFFNLPIELVAALGYASVFGSATNTFFAPVFIGAEVFGYSYLPYFFVVCAISYIF

SEQ ID NO: 166 - protein, 329 aa, Clostridium difficile QCD-32g58
GVVIAYCYFKFGGKSSKGMNLIFEVGHGEEEIIPLRLVPFIISGTWLTHLFGGSAGREGVAVQIGATFSHWVGKRLPIKNASSIFLVTGIAAGFAGLFETPIAAILFAMEVLVAGSLEYQSLFPAFTASFTASAVSKTLGLEKFSFALSSKVVFDLPIFWKLIVLGIIFGMVGGAFAWCLKLSKRKIGNRLKNPMIRIAIIGVCLSVLFLLFYKGRYSGLGTNLIQNSFYGGEIYSFDWLLKFILTILTLSAGFQGGEVTPLFSIGASLGVLLAGFFNLPIELVAALGYASVFGSATNTFFAPVFIGAEVFGYSYLPYFFVVCAISYIF

SEQ ID NO: 167 - protein, 329 aa, Clostridium difficile R20291; identical to SEQ ID NO: 166

SEQ ID NO: 168 - protein, 329 aa, Clostridium difficile CD196; identical to SEQ ID NO: 166

SEQ ID NO: 169 - protein, 329 aa, Clostridium difficile QCD-37x79; identical to SEQ ID NO: 166

SEQ ID NO: 170 - protein, 329 aa, Clostridium difficile QCD-97b34; identical to SEQ ID NO: 166

SEQ ID NO: 171 - protein, 329 aa, Clostridium difficile QCD-76w55; identical to SEQ ID NO: 166

SEQ ID NO: 172 - protein, 329 aa, Clostridium difficile CIP 107932; identical to SEQ ID NO: 166

SEQ ID NO: 173 - protein, 329 aa, Clostridium difficile QCD-66c26; identical to SEQ ID NO: 166

SEQ ID NO: 174 - protein, 331 aa, Streptococcus equi subsp. zooepidemicus
AGLVIVFLYEQYGQIAKQGMGLVFDVGHGEKTRLPLVLIPLIILSTWLTHLCGGSAGREGVAVQIGATVSHFFGRLSHLKDKSQLFLVMGMAAGFAGLFQTPMTAVVFALEVLLLGNISYLALLPSLIAAFTASWTSHCLGLEKFSVPIAKALKITPITFGKLVLLGLIFGLAGNLFASLLARAKPYIAARLPNPYYRVLLVGGFLSLSLLLCHYGRYSGLGTNLITAAFSHQPIANYDWLLKLLFTIITLSAGFQGGEVTPLFAIGAALGIVLAPWLGLPAQLAAALGYAAVFGSATNTFLAPIFVGLEVFGATNATAYFIVIAFAYMVS

SEQ ID NO: 175 - protein, 329 aa, Clostridium difficile QCD-63q42
GVVIAYCYFKFGGKSSKGMNLIFEVGHGEEEIIPLRLVPFIISGTWLTHLFGGSAGREGVAVQIGATFSHWVGKRLPIKNASSIFLVTGMAAGFAGLFETPIAAILFAMEVLVAGSLEYQSLFPAFTASFTASAVSKALGLEKFSFALSSEVVFDLSIFWKLIVLGIIFGMVGGAFAWCLKLSKRKIGNRLKNPMIRIAIIGVCLSVLFLLFYKGRYSGLGTNLIQNSFYGGEIYSFDWLLKFILTILTLSAGFQGGEVTPLFSIGASLGVLLAGFFNLPIELVAALGYASVFGSATNTFFAPVFIGAEVFGYSYLPYFFVVCAISYIF

SEQ ID NO: 176 - protein, 329 aa, Clostridium difficile ATCC 43255
GVVIAYCYFKFGGKSSKGMNLIFEVGHGEEEIIPLRLVPFIISGTWLTHLFGGSAGREGVAVQIGATFSHWVGKRLPIKNASSIFLVTGMAAGFAGLFETPIAAILFAMEVLVAGSLEYQSLFPAFTASFTASSVSKALGLEKFSFALSSKVVFDLSIFWKLIVLGIIFGMVGGAFAWCLKLSKRKIGNRLKNPMIRIAIIGVCLSVLFLLFYKGRYSGLGTNLIQNSFYGGEIYSFDWLLKFILTILTLSAGFQGGEVTPLFSIGASLGVLLAGFFNLPIELVAALGYASVFGSATNTFFAPVFIGAEVFGYSYLPYFFVVCAISYIF

SEQ ID NO: 177 - protein, 331 aa, Streptococcus equi subsp. equi 4047
AGLVIVFLYEQYGQIAKQGMGLVFDVGHGEKTRLPLVLIPLIILSTWLTHLCGGSAGREGVAVQIGATVSHFFGRLRHLKDKSQLFLVMGMAAGFAGLFQTPMTAVVFALEVLLLGNISYLALLPSLIAAFTASWTSHCLGLEKFSVPIAKALKITPITFGKLVLLGLIFGLAGNLFASLLARAKPYIAARLPNPYYRVLLVGGFLSLSLLLCHYGRYSGLGTNLITAAFSHQPIANYDWLLKLLFTIITLSAGFQGGEVTPLFAIGAALGIVLAPWLGLPAQLAAALGYAAVFGSATNTFLAPIFVGLEVFGATNATAYFIVIAFAYMVS

SEQ ID NO: 178 - protein, 329 aa, Clostridium difficile NAP07
GVVIAYCYFKFGGKSSKGMNLIFEVGHGEEEIIPLRLIPFIISGTWLTHLFGGSAGREGVAVQIGATFSHWIGKRLPIKNASSIFLVTGMAAGFAGLFGTPIAAILFAMEVLVAGSLEYQSLFPAFIASFTASEVTKALGLEKFSFALSSKVVFDLSIFWKFIALGIIFGMVGGAFAWCLKLSKRKICNRLKNPMIRIAIIGACISILFLLFDKGRYSGLGTNLIQNSFYGGEIYSFDWLLKFVLTILTLSAGFQGGEVTPLFSIGASLGVLLAGFFNLPIELVAALGYASVFGSATNTFFAPVFIGAEVFGYSYLPYFFVVCAISYVF

SEQ ID NO: 179 - protein, 329 aa, Clostridium difficile NAP08; identical to SEQ ID NO: 178

SEQ ID NO: 180 - protein, 329 aa, Clostridium difficile QCD-23m63; identical to SEQ ID NO: 178

SEQ ID NO: 181 - protein, 333 aa, Streptococcus parasanguinis ATCC 15912
AGFVIVYLYKRFGGKASKGMGLIFDVGHAREEEIPLVLVPLIMLTTWMSHLFGGSVGREGVAVQIGATLSHRFARYIKIPDASRIFLMTGMAAGFAGLFQTPLAATFFALEVLTVGELQLMALYPALIASIVASFTSHALGLEKFAVPLRETLSWTPETLIKVALLGLAFGLAGKLFAVSLSWLKKTVAQVLPNPYIRIALIGAGLSLVLLNLQLTKVGTYSGLGTNLIDVAFHQGSAQSYDWILKLLFTVVTISAGYQGGEVTPLFAIGATLGVFLAPMLGLPVLVVAAIGYASVFGSATTTLLAPILIGGEVFGYANLPFFVIACAIAYCL

SEQ ID NO: 182 - protein, 332 aa, Carnobacterium sp. AT7
AGLIIVYMYKKIGKNTNKGMSLVFSAGNEELHEIPKRMIPLTIIGTWITHLFGGSAGREGVAVQIGATFSHAIGRKIPFKNASKIMLITGMAAGFGGLFETPFAATFFALEVLVVGKLEYLALFPALIAAFVASYVSHFLGLEKFSVNLDVAVTMDSQTIVKMIFLGMIFGIVGGLFAYVLGYSKQFIGKKIPNLSKRIFFVGILISLLLLIFQMGRYSGLGTNLIAASFSGGSIYGYDWLLKFLLTILSLAAGFQGGEVTPIFSIGASLGVWLAPLFGLPIEFVAALGYASVFSSATNTLIAPALIGAEVFGFNYLPYFLLTVCISYVFNG

SEQ ID NO: 183 - protein, 330 aa, Streptococcus mutans UA159
AGLIIVYLYQKWGAKSSKGMGLIFQVGFEEEDHIPKRLIPMVIVTTWLTHLCGGSAGREGVAVQLGATVSHWFSRLFHFPNKSRIFLLSGMAAGFAGLYQTPMAAILFALEVLVLGNLGLSALVPMTIASFTASLTSHSLGLEKFAHTLSRTISLTPTVFIQLLILGLIFGLAGNLFAFLLAWCKQVQARLLPNLYRRIFIVGLLLSLLFLVLYQGRYSGLGTNLISASFSDGKIYVYDWLLKLFLTVITLAAGFQGGEVTPLFAIGSSLGVVLAGIFHLPLEFVAALGYISVFGSATNTFLAPILIGGEVFGYQNLPAYFIAVTFAYVV

SEQ ID NO: 184 - protein, 330 aa, Streptococcus mutans NN2025
AGLIIVYLYQKWGAKSSKGMGLIFQVGFEEEDHIPKRLIPMVIVTTWLTHLCGGSAGREGVAVQLGATVSHWFSRLFHFPNKSRIFLLTGMAAGFAGLYQTPMAAILFALEVLVLGNLGLSALVPMTIASFTASLTSHSLGLEKFAHTLSRTISLTPTVFIQLLILGLIFGLAGNLFAFLLAWCKQVQARLLPNLYRRIFIVGLLLSLLFLVLYQGRYSGLGTNLISASFSDEKIYVYDWLLKLFLTVITLAAGFQGGEVTPLFAIGSSLGVVLAGIFHLPLEFVAALGYISVFGSATNTFLAPILIGGEVFGYQNLPAYFIAVTFAYVV

SEQ ID NO: 185 - protein, 329 aa, Streptococcus infantarius subsp. infantarius ATCC BAA-102
GLVIVFLYQKADSRASKGMGLLFAVSQGDEKKIPLVMLPLVTVATWLTHLFGGSAGREGVAVQLGATISHAFSKFFSFENSSRLFLVTGMAAGFAGLFQTPLAAVFFGLEILVLGKLQLPALLPMTIASFVASATSHALGLEKFAHFVNVSLTFNAWLFCKLALLGLIFGLVGNAFAALLAYAKQKAKEVMDNPYYRILFGGIVLSLLFLMLYHGRYSGLGTNLIDASFSGKVIYFYDWLLKLVLTVATLAIGFQGGEVTPLFAIGASLGVVLAKVFGLPVEFVAAAGYISVFGSATNTLLAPIFIGGEVFGFANLPYFALVMIFAYSL

SEQ ID NO: 186 - protein, 333 aa, Paenibacillus sp. Y412MC10
GGAAVSFLYYKFGKSSAKGNNLILEQIHGGTESIPLRMAPLVLIGTLITHLFGGSAGREGTAVQMGGSLSEWLGKLIRVTPSDRKILLICGISGGFGSIFGTPLAGTLFGLEVLAIGLVSHQALLPAFAASMVGNLTATSLWGVSHLHYPIGDIPALGFMVIMKVVFASMLFGLTSRLFSELTHSLKRWYGFVFHNPMVKSAAGGVIIIGLVYLLGTRDYLGLGIPLIEAAFAGEVSPFAFLGKIIFTSLTLGAGFQGGEVTPLFAIGATLGSALSEWIGLHAPFLAALGFIAVFCGATNTPIACFIMGIELFGGEGAVYMFMACVISYLFSG

SEQ ID NO: 187 - protein, 332 aa, Granulicella mallensis MP5ACTX8
AGVLVGLMYHYFGRSVEAGNNLLLDEIHDPKAVIPFRMTPLILLGTFLTHLFGGSAGREGTALQTGASLADQLTRPLRLAPRDRRILLMAGISAGFGSVFGTPLAGALFGIEVLAIGRLSYEALAPCMIAAFVGDLVTNAWGIHHTIYRVTSVPEINVKGILAAMAAGAAFGLVGMAFAKTTHAISHFVRSRIPFAPLRPAAGGILVTAAVFALGTTKYIGLGIPTIVASFDHKLPAYDWAAKFLFTAVTLGTGFKGGEVTPLFYIGSTLGNALSSLLPLPPSLLAGMGFVAVFAGAANTPIASTLMAVELFGAEAGAFAGIACIISYLFSG

SEQ ID NO: 188 - protein, 332 aa, Clostridium butyricum E4 str. BoNT E BL5262
AGVAIVYIYNKIGKNSIKGMTLVFESADKEDAVIPKRLIPLTILSTWITHLFGGSAGREGVAVQIGATVAHNIGRKIDIENSGRIFLITGMAAGFAGLFQTPIAAVFFALEVLVAGTLEYSALFTALIGAFSASTTSHLLGLEKFTFALKTNITIDLNFIIKLALIGIIFGVVGGLFAHVLGKMKKILGDLIKNPILKIFVIGIILSILLIVMHTGRYSGLGTNLISSSFNGSSIYNYDWILKFIFTIVTLAAGFQGGEVTPLFSIGASLGVFLGNLMGLPIELVAALGYACVFGGATNTFIAPIFIGAEVFGFEYVPLFFVACSLAYIFNG

SEQ ID NO: 189 - protein, 332 aa, Clostridium butyricum 5521; identical to SEQ ID NO: 188

SEQ ID NO: 190 - protein, 329 aa, Streptococcus gallolyticus UCN34
GLLIVFLYQKADERASKGMGLVFAVGQSQEKEIPLILVPLVTLATWLTHLFGGSAGREGVAVQLGAAIAHGFSRFFDFENNSRLFLVTGMAAGFAGLFQTPIAAVFFALEILVLGKLQLQALLPMTVASFVASATSHSLGLEKFSHLVSADLTLDVMIFCKLAVLGIIFGLVGNLFAKLLAIAKEKAKDVMDNPYYRILFGGILLSLIFLICYHGRYSGLGTNLIEASFAGKEIYLYDWLLKLLLTVATLAIGFQGGEVTPLFAIGASLGVVLANLFGLPVEFVAAAGYISVFGSATNTLIAPIFIGGEVFGFANLPYFVVVMIFAYSV

SEQ ID NO: 191 - protein, 329 aa, Streptococcus gallolyticus subsp. gallolyticus TX20005
GLLIVFLYQKADERTSKGMGLVFAVGQSQEKEIPLILVPLVTLATWLTHLFGGSAGREGVAVQLGAAIAHGFSRFFDFENNSRLFLVTGMAAGFAGLFQTPIAAVFFALEILVLGKLQLQALLPMTVASFVASATSHSLGLEKFSHLVSADLTLDVMIFCKLAVLGIIFGLVGNLFAKLLAIAKEKAKDVMDNPYYRILFGGILLSLIFLICYHGRYSGLGTNLIEASFAGKEIYLYDWLLKLLLTVATLAIGFQGGEVTPLFAIGASLGVVLANLFGLPVEFVAAAGYISVFGSATNTLIAPIFIGGEVFGFANLPYFVVVMIFAYSV

SEQ ID NO: 192 - protein, 332 aa, Lactococcus lactis subsp. cremoris MG1363
AGLLIVYLYKNFGKDSQKGMGLIFEAGNHGREDIPKRLVPLIVFSTWLSHLFGASVGREGVAVQIGGVIGHAIGKKLSAKEAKKILLITGMAAGFAGLFQTPIAATFFAIEILMLGKIEYRALIPALVGSYVASWTSNYLGLEKFSFAINTNIHLDPLVLLKLAIIAVCFGLVGRFFAESLAFMKATVAKRIANPYQRIILMGIVISIGLLVIHMDRYAGLGTNLIGLSFNGGHINGYDWILKLIFTVLSISAGFQGGEVTPLFAIGSTLGAALAMLFGLPVEFVAAAGYVSIFSAATNSYFGPIFIAAEVFGFGSVQYILPIMTIAYVLNG

SEQ ID NO: 193 - protein, 329 aa, Streptococcus bovis ATCC 700338
GLLIVFLYQKADERVSKGMGLVFAIGQSQEKEIPLILVPLVTLATWLTHLFGGSAGREGVAVQLGAAIAHGFSRFFDFENNSRLFLVTGMAAGFAGLFQTPIAAVFFALEILVLGKLQLQALLPMTVASFVASATSHSLGLEKFSHLVSADLTLDVMTFCKLAVLGIIFGLVGNLFAKLLAIAKEKAKDVMDNPYYRILFGGILLSLIFLICYHGRYSGLGTNLIEASFAGKEIYFYDWLLKLLLTVATLAIGFQGGEVTPLFAIGASLGVVLANLFGLPIEFVAAAGYISVFGSATNTLIAPIFIGGEVFGFANLPYFVVVMIFAYSV

SEQ ID NO: 194 - protein, 329 aa, Streptococcus mutans UA159
AGLLIVFIYDHFGGKSIKGMSLVFDVADEREVTIPKRLVPLAIFSTWLTHLFGGSAGREGVAIQVGAALSHAFSPVFKFEESSRSFLIIGIAAGFAGLFQTPMAAILFALEVLVIGRLELSTLLPTSLAAYTASYTSQLLGLKNFTHLIKVHMTLNPVLFVKFALLGIIFGLVGTSFAYLLRRTKLSLILRFKRPYQRIMIVGLLLSVLFTAAGMGRYSGLSTDLVTASFAKGTVYPFDWLFKLILTVLTLSAGYQGGEVMPMFTIGATLGAVLAPLFHLPIAFVAALGYASVFGSGTSTFLAPIFIGGEIFGFENIPYFFIVVCFASI

SEQ ID NO: 195 - protein, 348 aa, Pedosphaera parvula Ellin514
GGVAVGLLYHWLGREAEKGSNLIIDEIHKPGGGVPRRMAPLVLIGTLITHLFGGSAGREGTAVQMGGSLASGFGRLIRVKSETMRILLMSGVAAGFGSVFGTPLTGAVFAMEVLAVGRIQYDALVPTLIASVVGDYTCSAWGIKHAIYQISFIEPEAASAIFHVDALLLLKAVTAGIAFGLCSLLFSELAHSLQKAYKKLVPLAPLRPVLGGVMVIALVYLVGTRDYLGLGITSPDPKAVTILSAFHPDGAHVLSWWWKIVFTIVTISSGFKGGEVTPLFFIGATLGNALSGLLHAPVDLFAGLGFIGVFAGATNTPLACTIMGIELFGAHYTVYFAAACFIAYFFSG

SEQ ID NO: 196 - protein, 332 aa, Clostridium perfringens NCTC 8239
GGALVSFLYYKFGRNSVKGNNLIIENINNYCGDVPLRMVPLVFFGTIVTHFFGGSAGREGTGVQIGASIAETIGKLLKLNKEDSKIMLMAGVSGGFSAIFGTPLAGTIFGLEVSVLGKMSYEALIPSFFASIMGNEIVKILGVHHSHYKVLGVPDISALIILKVIISAICFGLASRLFSELTHKLKGLFSNKFKNTSLKSFVGGCIVILLVYLIGSRKYLGLSLPLLSEAFNRHVSPFDFLGKLIFTSITLGAGYQGGEVTPLFVIGSTLGNTLSGILNLPPSFLASLGLVGVFAGATNTPIASFVLGIEMFGVGGAPYLFMACAISYIFSG

SEQ ID NO: 197 - protein, 332 aa, Lactococcus lactis subsp. lactis KF147
AGLLIVYIYKNFGKDSQKGMGLIFEAGNHGREDIPKRLVPLIIFSTWLSHLFGASVGREGVAVQIGGVIGHAIGKKLSAKEAKKILLITGMAAGFAGLFQTPIAATFFAIEILMLGKIEYRALIPALVGSYVASWTSSSLGLEKFSFAINTNIHIDPLVLLKLAVIAVCFGLVGRFFAESLAFMKATVAKRIVNPYYRIILMGIVISIGLLVIHLDRYAGLGTNLISLSFNGGHINGYDWILKLIFTVLSISAGFQGGEVTPLFAIGSTLGAALAMLFGLPVEFVAAAGYVSIFSAATNSYFGPIFIAAEVFGFGSVQYILPIMTIAYVLNG

SEQ ID NO: 198 - protein, 330 aa, Streptococcus thermophilus LMD-9
AGLLIVYLYQKFAGKTAQGMGLIFKVGHNEEDQVPLRLIPLVTVTTWLTHLFGGSAGREGVAVQLGATVSHAFSRYFKLPNASCIFLTMGMAAGFGGLFQTPIAATFFALEVLTLGQLSLPILVPTLIASFMASTTSHLLGLEKFSHFVSKSLTIDLETFMKLALLGLAFGLAGNLFAYLLSLAKKKVASLLPNPYYRVLLGGVVLTCLLLILCKGRYTGLGTNLIALSVDGGTIYPLDWLFKLLLTVFTLSLGFQGGEVTPLFAIGASLGAVLAPILGLPISLVAGLGYLSVFGSSTNTLLAPIFIGIEVFGPANAIPYAIVMAFAYII

SEQ ID NO: 199 - protein, 329 aa, Streptococcus mutans NN2025
AGLLIVFIYDHFGGKSIKGMSLVFDVADEREVTIPKRLVPLAIFSTWLTHLFGGSAGREGVAIQVGAALSHAFSPVFKFEESSRSFLIIGIAAGFAGLFQTPMAAILFALEVLVIGRLELSTLLPTSLAAYTASYTSQLLGLKNFTHLIKVHMTLNPVLFVKFALLGIIFGLVGTSFAYLLRRTKLSLILRFKRPYQRIMIVGLLLSVLFTAAGMGRYSGLSTDLVTASFAKGTVFPFDWLFKLILTVLTLSAGYQGGEVMPMFTIGATLGAVLAPLFHLPIAFVAALGYASVFGSGTSTFLAPIFIGGEIFGFENIPYFFIVVCFASI

SEQ ID NO: 200 - protein, 332 aa, Lactococcus lactis subsp. lactis Il1403
AGLLIVYIYKNFGKDSQKGMGLIFEAGNHGREDIPKRLVPLIVFSTWLSHLFGASVGREGVAVQIGGVIGHAIGKKLSAKEAKKILLITGMAAGFAGLFQTPIAATFFAIEILMLGKIEYRALIPALVGSYVASWTSSSLGLEKFSFAINTNIHIDPLVLLKLAVIAVCFGLVGRFFAESLAFMKATVAKRIVNPYYRIILMGIVISIGLLVIHLDRYAGLGTNLISLSFNGGHINGYDWILKLIFTVLSISAGFQGGEVTPLFAIGSTLGAALAMLFGLPVEFVAAAGYVSIFSAATNSYFGPIFIAAEVFGFGSVQYILPIMTIAYVLNG

SEQ ID NO: 201 - protein, 332 aa, Lactococcus lactis subsp. cremoris SK11
AGLLIVYLYKNFGKDSQKGMGLIFEAGNHGREDIPKRLVPLIVFSTWLSHLFGASVGREGVAVQIGGVIGHAIGKKLSAKEAKKILLITGMAAGFAALFQTPIAATFFAIEILMLGKIEYRALIPALVGSYVASWTSNYLGLEKFSFAINTNIHLDPLVLLKLAIIAVCFGLVGRFFAESLAFMKATVAKRIANPYQRIILMGIVISIGLLVIHMDRYAGLGTNLIGLSFNGGHINGYDWILKLIFTVLSISAGFQGGEVTPLFAIGSTLGAALAMLFGLPVEFVAAAGYVSIFSAATNSYFGPIFIAAEVFGFGSVQYILPIMTIAYVLNG

SEQ ID NO: 202 - protein, 330 aa, Enterococcus casseliflavus EC10
GICFTYLFQKYGDRSPQGMNLVFLVGQEEEKDIPLRLIPFVMVGTWLTHLFGGSAGREGVAVQLGATIANRLGNWVRLEKYASTLIMIGMAAGFAGLFETPIAATFFALEVLVIGKFSHHALLPALLAAFTASTTSQWLGLEKFSLMLPQSVDLTIPVFLKLLVIGLIFGMVGGSFAGCLETMKRIMKRRFPNPLWRIGIGALALVLLFVLLYQGRYSGLGTNLISASFTNQPIYSYDWLLKLVLTVLTISSGFLGGEVTPLFAIGSSLGVVLAPLFGLPIELVAALGYASVFGSATSTLFAPIFIGGEVFGFQNLPFFVIVCSVAYFIS

SEQ ID NO: 203 - protein, 330 aa, Enterococcus casseliflavus EC30; identical to SEQ ID NO: 202

SEQ ID NO: 204 - protein, 330 aa, Streptococcus thermophilus LMG 18311
AGLLIVYLYQKFAGKAAQGMGLIFKVGHNEEDQVPLRLIPLVTVTTWLTHLFGGSAGREGVAVQLGATVSHAFSRYFKLPNASCIFLTMGMAAGFGGLFQTPIAATFFSLEVLTLGQLSLPILVPTLIASFMASTTSHLLGLEKFSHFVSKSLTIDLETFMKLALLGLAFGLAGNLFAYLLSLAKKKVASLLPNPYYRVLLGGVVLTCLLLILCKGRYTGLGTNLIALSVDGGTIYPLDWLFKLLLTVFTLSLGFQGGEVTPLFAIGASLGAVLAPILGLPISLVAGLGYLSVFGSSTNTLLAPIFIGIEVFGPANAIPYAIVMAFAYLI

SEQ ID NO: 205 - protein, 332 aa, Clostridium perfringens D str. JGS1721
GGALVSFLYYKFGRNSVKGNNLIIENINNYCGDVPLRMVPLVFFGTIVTHFFGGSAGREGTGVQIGASIAETIGKLLKLNKEDSKIMLMAGVSGGFSAIFGTPLAGTIFGLEVSVLGKMSYEALIPSFFASIVGNEVVKILGVHHSHYKVLGVPDISVLIILKVIISAICFGLASRLFSELTHKLKGLFSNKFKNTSLKSFVGGCIVILLVYLIGSRKYLGLSLPLLSEAFDGHVSPFDFLGKLIFTSITLGAGYQGGEVTPLFVIGSTLGNTLSGILNLSPSFLASLGLVGVFAGATNTPIASFVLGIELFGVGGAPYLFMACAISYIFSG

SEQ ID NO: 206 - protein, 332 aa, Clostridium perfringens SM101
GGALVSFLYYKFGRNSVKGNNLIIENINNYCGDVPLRMVPLVFFGTVVTHFFGGSAGREGTGVQIGASIAETIGKLLKLNKEDSKIMLMAGVSGGFSAIFGTPLAGTIFGLEVSVLGKMSYEALIPSFFASIVGNEVVKNLGVHHSHYKVLGVPDISALIILKVIISAICFGLASRLFSELTHKLKKVFSNKFKNTSLKSFVGGCIVILLVYLVGSRKYLGLSLPLLSEAFNGHISPFDFLGKLIFTSITLGAGYQGGEVTPLFVIGSTLGNTLSGILNLSPSFLASLGLVGVFAGATNTPIASFVLGIEMFGVGGAPYLFMACAISYIFSG

SEQ ID NO: 207 - protein, 330 aa, Streptococcus thermophilus CNRZ1066
AGLLIVYLYQKFAGKAAQGMGLIFKVGHNEEDQVPLRLIPLVTVTTWLTHLFGGSAGREGVAVQLGATVSHAFSRYFKLPNASCIFLTMGMAAGFGGLFQTPIAATFFALEVLTLGQLSLPILVPTLIASFMASTTSHLLGLEKFSHFVSKSLTIDLETFMKLALLGLAFGLAGNLFAYLLSLAKKKVASLLPNPYYRVLLGGVVLTCLLLILCKGRYTGLGTNLIALSVDGGTIYPLDWLFKLLLTVFTLSLGFQGGEVTPLFAIGASLGAVLAPILGLPISLVAGLGYLSVFGSSTNTLLAPIFIGIEIFGPVNAIPYAIVMAFAYLI

SEQ ID NO: 208 - protein, 348 aa, Gluconacetobacter diazotrophicus PAl 5
AGVAVGLTYHVLGRQAEGGNNLIVDQIHEPGGGVPLRMAPLVLAGTVVSHLFGASVGREGTAVQIGGSIASGFTRLFRLTAREVRTLLTAGIAAGFGGVFGTPVAGAVFAMEVLSIGRMEYSAIVPVAVAAIAADWTCHAWGIHHVTYTLPFRGYPDAGGTAFHADPLLLARVAAAGVAFGLASLAFAQAVHRLGAVFRALCPVAWLRPAIGGVLTIVLVFLAGSRDYLGLGITAPEPGGASILDFFGPAHYAWSWLWKLAFTVAALATGFKGGEVTPLFFIGAGLGNALAPLLHAPVDLLAAVGFVAVFAGAANTPLACTLMGIELFGAADIVYLAVGCFVAYLCSG

SEQ ID NO: 209 - protein, 332 aa, Clostridium perfringens C str. JGS1495
GGALVSFLYYKFGRNSVKGNNLIIENINDYCGDVPLRMVPLVFFGTVVTHFFGGSAGREGTGVQIGASIAETIGKLLKLNKEDSKIMLMAGVSGGFSAIFGTPLAGTIFGLEVSVLGKMSYEALIPSFFASIVGNEVVKNLGVHHSHYKVLGVPDISAFIILKVIISAICFGLASRLFSELTHKLKGLFSNKFKNTSLKSFVGGCIVILLVYLIGSRKYLGLSLPLLSEAFNGHVSPFDFLGKLIFTSITLGAGYQGGEVTPLFVIGSTLGNTLSGILNLSPSFLASLGLVGVFAGATNTPIASFVLGIEMFGVGGAPYLFMACAISYIFSG

SEQ ID NO: 210 - protein, 332 aa, Clostridium perfringens ATCC 13124
GGALVSFLYYKFGRNSVKGNNLIIENINNYCGDVPLRMVPLVFFGTVVTHFFGGSAGREGTGVQIGASIAETIGKLLKLNKEDSKIMLMAGVSGGFSAIFGTPLAGTIFGLEVSVLGKMSYEALIPSFFASIVGNEVVKILGVHHSHYKVLGVPDISVLIILKVIISAICFGLASRLFSELTHKLKGLFSNKFKNTSLKSFVGGCIVILLVYLVGSRKYLGLSLPLLSEAFDGHVSPFDFLGKLIFTSITLGAGYQGGEVTPLFVIGSTLGNTLSGILNLSPSFLASLGLVGVFAGATNTPIASFVLGIEMFGVGGAPYLFMACAISYIFSG

SEQ ID NO: 211 - protein, 332 aa, Clostridium perfringens B str. ATCC 3626; identical to SEQ ID NO: 210

SEQ ID NO: 212 - protein, 329 aa, Streptococcus suis BM407
AGVLIVFIYQKWGREVQAGMGLVFKAGQGEKAQISPVLIPLIISTTWLSHLVGASVGREGVAVQLGASLSHWLQKHGFTHLPKDMITKIGMAAGFAGLFQTPWAAGFFAIEVLIVGQYSWTSLPYCLVAAFTASTTSHLLGLEKFSHTIATTSFYFTDSFKWLFIALCFGFIGNLFALFLAQAKSISTRWLPNPYIKIAIMGVGLTVLLFFFHQGRYTGLGTNLIDASLAGEQVFAFDWLLKLLLTCLCLAAGFQGGEVTPLFAIGASSGAVLAGLLGLPTELVAALGYCAVFGTATNTLLAPLFISYEVFGANILPYAIPVLAIAYLI

SEQ ID NO: 213 - protein, 329 aa, Streptococcus suis P1/7; identical to SEQ ID NO: 212

SEQ ID NO: 214 - protein, 329 aa, Streptococcus suis SC84; identical to SEQ ID NO: 212

SEQ ID NO: 215 - protein, 329 aa, Streptococcus suis 98HAH33; identical to SEQ ID NO: 212

SEQ ID NO: 216 - protein, 329 aa, Streptococcus suis 05ZYH33; identical to SEQ ID NO: 212

SEQ ID NO: 217 - protein, 348 aa, Chitinophaga pinensis DSM 2588
AGILIHFLYKKLGGTSEAGNNLIMDEIHEPGGGVPARMAPLVIATTIITHLFGGSAGREGTAVQIGGSMAHMLGRWFRLSAADVKIILMTGIAAGFGAVFGTPLTGAVFALEVLAIGLMRYDALIPCLIAAVFADIVCSAWGIHHTHYQILFESNHISFHFVHFDLLLLIKVIACGIAFGLASFLFATCMRNIKSYAKAWIKIPLLIPAIGGLIVIGGCYLLGTRDYIGLGVTTPDPNGVSIVNAFTTKEISSWGWLWKLLLTAITLGMGFKGGEVTPLFFIGATLGHTLAVLMGAPVDLFAGLGFIAVFAGATNTPIACTLMGVELFGTTHVLYFAVACFTAYYFSG

SEQ ID NO: 218 - protein, 332 aa, Clostridium perfringens E str. JGS1987
GGALVSFLYYKFGRNSVKGNNLIIENINNYCGDVPLRMVPLVFFGTVVTHFFGGSAGREGTGVQIGASIAETIGKLLKLNKEDSKIMLMAGVSGGFSAIFGTPLAGTIFGLEVSVLGKMSYEALIPSFFASIVGNEVVKILGVHHSHYKVLGVPDISVLIILKVIISAICFGLASRLFSELTHKLKGLFSNKFKNTSLKSFVGGCIVILLVYLIGSRKYLGLSLPLLSEAFDGHVSPFDFLGKIIFTSITLGAGYQGGEVTPLFVIGSTLGNTLSGILNLSPSFLASLGLVGVFAGATNTPIASFVLGIEMFGVGGAPYLFMACAISYIFSG

SEQ ID NO: 219 - protein, 332 aa, Clostridium perfringens CPE str. F4969
GGALVSFLYYKFGRNSVKGNNLIIENINNYCGDVPLRMVPLVFFGTIVTHFFGGSAGREGTGVQIGASIAETIGKLLKLNKEDSKIMLMAGVSGGFSAIFGTPLAGTIFGLEVSVLGKMSYEALIPSFFASIVGNEVVKILGVHHSHYKVLGVPDISALIILKVIISAICFGLASRLFSELTHKLKKIFSNKFKNTSLKSFVGGCIVILLVYLVGSRKYLGLSLPLLSEAFNGHVSPFDFLGKLIFTSITLGAGYQGGEVTPLFVIGSTLGNTLSGILNLSPSFLASLGLVGVFAGATNTPIASFVLGIEMFGVGGAPYLFMACAISYIFSG

SEQ ID NO: 220 - protein, 332 aa, Clostridium perfringens str. 13
GGALVSFLYYKFGRNSVKGNNLIIENINNYCGDVPLRMVPLVFFGTVVTHFFGGSAGREGTGVQIGASIAETIGKLLKLNKEDSKIMLMAGVSGGFSAIFGTPLAGTIFGLEVSVLGKMSYEALIPSFFASIVGNEVVKILGVHHSHYKVLGVADISVLIILKVIISAICFGLASRLFSELTHKLKGLFSNKFKNTSLKSFVGGCIVILLVYLVGSRKYLGLSLPLLSEAFNGHVSPFDFLGKLIFTSITLGAGYQGGEVTPLFVIGSTLGNTLSGILNLSPSFLASLGLVGVFAGATNTPIASFVLGIEMFGVGGAPYLFMACAISYIFSG

SEQ ID NO: 221 - protein, 348 aa, SOURCE      Clostridium perfringens str. 13
AGVAVGLTYHVLGRQAEGGNNLIVDQIHEPGGGVPLRMAPLVLAGTVVSHLFGASVGREGTAVQIGGSIASGFTRMFRLTAREVRTLLTAGIAAGFGGVFGTPVAGAVFAMEVLSIGRMEYSAIVPVAVAAIAADWTCHAWGIHHVTYTLPFRGYPDAGGTAFHADPLLLARVAPAGVAFGLASLAFAQAVHRLGAVFRALCPVAWLRPAIGGVLTIVLVFLAGSRDYLGLGITAPEPGGASILDFFGPAHYAWSWLWKLAFTVAALATGFKGGEVTPLFFIGAGLGNALAPLLHAPVDLLAAVGFVAVFAGAANTPLACTLMGIELFGAADIVYLAVGCFIAYLCSG

SEQ ID NO: 222 - protein, 349 aa, Chthoniobacter flavus Ellin428
AGVAVGLLYHYYGRSAEGGNNLIMDQIHEPGGGVPRRMAPLVLFGTLVTHLFGGSAGREGTAVQMGGSIASAFCRWYRLDASSVRILLMAGIAAGFGAVFGTPLAGAVFALEVLMIGRIEYEALLPAFIAAVAGDWTCHAWGIGHTHYHIDFLASNAAPSAFFHLDPKLLLKVVVASAAFGMASTAFSELSHRLSALFKRLVPYGPWRPAVGGLVVIGLFFLVGTSDYLGLGVSSPDPRAVTIVSFFQSPEIHYWSWFWKIIFTAVTLSAGFKGGEVTPLFYIGAALGNALAGIMGAPTDLFAALGFVAIFAGASNTPLACTLMGVELFGATHVIYIATACFLAYLFSG

SEQ ID NO: 223 - protein, 330 aa, Enterococcus casseliflavus EC20
GICFTYLFQKYGDRSPQGMNLVFLVGQEEEKDIPLRLIPFVMVGTWLTHLFGGSVGREGVAVQLGATIANRLGNWLRLEKYASTLIMIGMAAGFAGLFETPIAATFFALEVLVIGKFSHHALLPALLAAFTASTTSQWLGLEKFSLMLPQSVDLTIPVFLKLLVIGLIFGMVGGSFAGCLETMKRIMKRRFPNPLWRIGIGALALALLFVLLYQGRYSGLGTNLISASFTKQPIYSYDWLLKLVLTVLTISIGFLGGEVTPLFAIGSSLGVVLAPLFGLPIELVAALGYASVFGSATSTLFAPIFIGGEVFGFQNLPFFVIVCSVAYFIS

SEQ ID NO: 224 - protein, 331 aa, Paenibacillus sp. JDR-2
GALMSFFYWKHGKNAGKGNNLILEQIRQGQETIPFRMAPLVLLGTLLTHLFGGSAGREGTAVQMGGSFSELIGKVFKVDETDRKILLMCGISSGFGSVFGTPLAGTVFGIEVIAIGFVRYQAILPCFIASFVGHLVTTAWGIHHIHYAMGKVPDLTAIVVIKVVFASIIFGLASIMFSELTHWLKKTFSKLFKNPVIKTFIGGVVVIVLVYLLGTREYLGLGIPLLQDSFEYPVAPLAFLWKTIFTALTLGAGFQGGEVTPLFVIGATLGNALAGLLHLAAPFLAGLGFIAVFSGATNTPIACFIMGIELFGSEGALYMFMACMISYLFSG

SEQ ID NO: 225 - protein, 309 aa, Streptococcus equi subsp. zooepidemicus MGCS10565
MFDVGHGEKAKLPLVLIPLIILSTWLTHLCGGSAGREGVAVQIGATVSHFFGRLSHLKDRSQLFLVMGMAAGFAGLFQTPMTAVVFALEVLLLGNISYLALLPSLIAAFTASWTSHCLGLEKFSVPIAKALKITPITFGKLVLLGLIFGLVGNLFAFLLARAKPYIAARLSNPYYRVLLVGSILSLSLLLCHYGRYSGLGTNLITSAFSHQTITNYDWLLKLLFTIITLSAGFQGGEVTPLFAIGAALGIVLAPWLGLPAQLAAALGYAAVFGSATNTFLAPIFVGLEVFGATNATAYFIVIAFAYMVS

SEQ ID NO: 226 - protein, 330 aa, Streptococcus uberis 0140J
GGLLIVYLYNRFGGKAKAGMGLIFDVGHAQEEDIPLVLIPLVIFSTWLTHLFGGSAGREGVAVQIGATLSHYFASYTKNKDLSKPFLLIGMSAGFAGLFQTPLAAIVFALEILVLDSIKLNALIPMTLAALTASATSHRLGLEKFSVAIGNPEPITLLLVLKLALLGLLFAVAGNVFAYLLSYGKNLLAERFPNPYLRIAVMGLLLSLLLFLFYQGRYSGLGTNLIQLSFTNHAIKSYDWFFKLFFTVVTIAAGFQGGEVTPLFSIGASLGIVLAPIFGLPLETVAALGYISVFSSATNTFLAPFLIGFEVFGPEHFLYYFIVLVFAYSI

SEQ ID NO: 227 - protein, 349 aa, Vibrio fischeri ES114
AGLAIVYSYRNWGKNSAGGNNLIMDEIHQAGEGVPVRMGPLVLFTTVITHLFGGSAGREGTAVQIGGATTDWLSKVFKLSEDDRKMMLTAGVAAGFASIFGTPFTGAIFALEVLFIGRIKFNAIIPALLAAILANVVASAWGAHHTHYLINFDQVSTLFGHAVDIDLLLMAKVIIAAIGFGIAGYLFGELTHGFKDLFNATLKNPYLIVVVGGLMVIIITQLLGNYDYIGIGVYPSRDGGVSITSAFTEGGAEWYSWILKLVLTAITLAAGYKGGEVTPLFFVGATLGNFLGWVMGAPVDLFAALGFLAVFAAATNTPLACTIMGVELFGAEYLPYFALACYTAYYFSG

SEQ ID NO: 228 - protein, 333 aa, Clostridium sp. SS2/1
AGFVITAIYYVFSKLSLKGMKLVFEVGQQKTDSIPLLLIPLVMIGTWLTHLFGGSAGREGVAVQIGATLSHALGRKLNFPENGRIMLVIGMAAGFGGLFQTPLSATFFAIEVIVIGKMDYEALLPALASAYIAAFTSHILGLEKFSVAIKNTINLTGTKTIISVIILGILFGLTGRLFSFSLSKLKVFMGETIMNQYLRIGVMAIPLAALLFIIHGSRYSGLGTNIISAGFAGQTIYSYDWLLKLLFTIFTLAIGFQGGEVTPLFSIGTSLGVILGGLLGLPPMLCAALGYAAVFGSATNTLIAPIMIGLEVFGGADMVLFVIVCVIAYGVNG

SEQ ID NO: 229 - protein, 330 aa, Streptococcus salivarius SK126
AGLLIVYLYQKFAGKAAQGMGLIFKVGHNEEDQVPLRLIPLVTVTTWLTHLFGGSAGREGVAVQLGATVSHAFSRYFKLPNASRIFLTMGMAAGFGGLFQTPIAATFFALEVLTLGQLSLPILVPTLIASFVASTTSHLLGLEKFSHFVSESLTIDLGTFMKLALLGLAFGLAGNLFAYLLSLAKKKVVSLLPNPYYRVLLGSVVLTCLLLILWKGRYTGLGTNLIALSVGGGTIYPLDWLLKLLLTVFTLSLGFQGGEVTPLFAIGASLGAVLAPVLGLPIPLVAGLGYLSVFGSSTNTLLAPIFIGVEVFGPANALPYAIVMAFAYLI

SEQ ID NO: 230 - protein, 349 aa, Vibrio fischeri MJ11
AGLAIVYSYRNWGKNSAGGNNLIMDEIHQAGEGVPVRMGPLVLFTTVITHLFGGSAGREGTAVQIGGATTDWLSKVFKLSEDDRKMMLTAGVAAGFASIFGTPFTGAIFALEVLFIGRIKFNAIIPALLAAILANVVASAWGAHHTHYLINFDQVSTLFGHAVDIDLLLMAKVIIAAIGFGIAGYLFGELTHGFKDLFNATLKNPYLIVVVGGLMVIIITQLLGNYDYIGIGVYPSRDGGVSITSAFTEGGAEWYSWILKLVLTAITLAAGYKGGEVTPLFFVGATLGNFLGWVMGAPVDLFAALGFLAVFAAATNTPLACTIMGVELFGSEYLPYFALACYTAYYFSG

SEQ ID NO: 231 - protein, 346 aa, Spirosoma linguale DSM 74
GVLILWLYQKGGKNAERGNNLLIDEIHQPGGGVPGRMAPLVLLTSLLTHLFGGSAGREGTAVQMGGSIAGVLGRQLRLSEADLRILLMSGIAAGFGAIFGTPLAGAVFALEVLTIGKLRYQALIPCLMASILGDITCAAWGIHHIHYQVAFSHTAIPTFSVPNGWLLTKVALAGALFGLAALVFSELTHGLQRLYKTYLPSTYLRPIIGGVLLIGLVWLVGTRDYLGLGVVSQQPNGISILNAFHSGGITPWSWFWKLLFTAITLSSGFKGGEVTPLFFIGACLGNLLAGWFNAPVDLFAALGFIAIFAGASNTPLASTLMGLELFGSDNLIFFAIACFVAYFFSG

SEQ ID NO: 232 - protein, 348 aa, Desulfuromonas acetoxidans DSM 684
AGIFIVWCYHSMGSTAGGGNNLVMEQIHQPGAGIPKRMMPLVLFATVITHLFGGSAGREGTAVQMGGSIAQVFSRPFRLSEEDTRILLTCGVAAGFGAVFGTPLAGAIFALEVLAVGKMRYEALIPCLMASVLGDLVCTAWGIGHTQYQIVAPELHIDAAVAHVSLVLAAKVMLASILFGLAGFLFAEITHALSGLFKKYVTRYWLRPVIGAVVVLGISFLLGTRDYLGLGVGSASGDGISIVNAFSGVGVTPWSWWWKLLLTAITLSSGFKGGEVTPLFFVGATLGAALAGVLGVPVDLLAGIGFIAVFAGATNTPLACTLMGVELFGAQYLEYFAIACFLSYLFSG

SEQ ID NO: 233 - protein, 331 aa, Enterococcus faecalis TX2134
GVVFTYFYTRFGKNASRGNNLVIEQGNSGEEDIPLRLIPLTLFGTITTHLFGGSVGREGTAVQMGGAIANAVGKVFKLSALERQVIIISGISAGFSSVFGTPLAGTVFGLEVLAIGKVRAEALFPSFFAGLFANFVTESFGVTHTHYPMGKIPTWSVDLFVKLFLASICFGLAGWVFSRSIVFLKKTYANWFANVYLRAFLGASIVVLFVLVLKNQRYLGLSLPLLEDAFAGNAQPFDFVGKLFFTVLSLGAGFQGGEVTPLFEIGATLGSSLAPLLHLSIPFLAGLGFIGVFSGATNTPIACFIMGIELFGSEAAVYFFMVCLISFMCSG

SEQ ID NO: 234 - protein, 346 aa, Verrucomicrobium spinosum DSM 4136
GGLLVGLLYHFWGRGSDKGNNLILEEIHAPGGGVPGRMAPLVLFGTLVSHLFGGSAGREGTAVQMGGSLASLLSRVCRLGPAARRMMLMCGVSAGFGSVFGTPLAGAVFAMEVLVVGRVQYEALVPVLVASIVGDATCSAWGVHHTIYHLDVAPGAGSHAAFQAVLLVKVAGSAICFGLASRLFSEVTHGLQRCFARLLPFAPLRPVLGGLLVIGLVLLTGTRDFLGLGVHAPPGGAVSILSSFEPGGASGWSWLGKLLFTSVTLGSGFKGGEVTPLFYVGATLGNAIGALLQEPVGLFAALGFIAVFAGAANTPLACTLMGIELFGAHYAVYFAVACFVAFMASG

SEQ ID NO: 235 - protein, 331 aa, Enterococcus faecalis X98
GVVFTYFYTRFGKNASRGNNLVIEQGNGGEEDIPLRLIPLTLFGTITTHLFGGSVGREGTAVQMGGAIANAVGKVFKLSALERQVIIISGISAGFSSVFGTPLAGTVFGLEVLAIGKVRAEALFPSFFAGLFANFVTESFGVTHTHYPMGKIPTWSVELFVKLFLASICFGLAGWVFSRSIVFLKKTYANWFANVYLRAFLGASIVVLFVLVLNNQRYLGLSLPLLEDAFAGNAQPFDFVGKLFFTVLSLGAGFQGGEVTPLFEIGATLGSSLAPLLHLSIPFLAGLGFIGVFSGATNTPIACFIMGIELFGSEAAVYFFMVCLISFMCSG

SEQ ID NO: 236 - protein, 352 aa, Chryseobacterium gleum ATCC 35910
AGLLIHFLYQSVGKSSEKGNNLIMDEIHQPGGGVPKRMAPIVLFATVITHLFGGSAGREGTAVQIGGSIAQMFGKWFRLNQRDTGIVLTAGIAAGFGAVFGTPLTGAIFALEVLAIGKIKYDALLPCLIAGTVGDITVSAWKIHHTHYHIDAIPPMDQSFWLSQYIPFDLLLLGKIIIASIAFGLASFIFAEMAHRIKNVMVASVSKKWLIPVIGGCVIILLTFINGKPDYLSLGVDPEYQGAVTIQSAFHAGGSDPWSWLWKTVYTTVTLGTGFKGGEVTPLFYIGATLGNTLSDLMNAPVGLFAALGFIAVFSGATNTPLACTLMGIELFGGEYTLYYAIACFTAYFFSG

SEQ ID NO: 237 - protein, 331 aa, Enterococcus faecalis ARO1/DG
GVVFTYFYTRFGKNASRGNNLVIEQGNGGEEDIPLRLIPLTLFGTITTHLFGGSVGREGTAVQMGGAIANAVGKVFKLSALERQVIIISGISAGFSSVFGTPLAGTVFGLEVLAIGKVRAEALFPSFFAGLFANFVTESFGVTHTHYPMGKIPTWSVDLFVKLFLASICFGLAGWVFSRSIVFLKKTYANWFANVYLRAFLGAAIVVLFVLVLNNQRYLGLSLPLLEDAFAGNAQPFDFVGKLFFTVLSLGAGFQGGEVTPLFEIGATLGSSLAPLLHLSIPFLAGLGFIGVFSGATNTPIACFIMGIELFGSEAAVYFFMVCLISFMCSG

SEQ ID NO: 238 - protein, 331 aa, Enterococcus faecalis TX0855; identical to SEQ ID NO: 235

SEQ ID NO: 239 - protein, 331 aa, Enterococcus faecalis TUSoD Ef11; identical to SEQ ID NO: 235

SEQ ID NO: 240 - protein, 331 aa, Enterococcus faecalis T11; identical to SEQ ID NO: 235

SEQ ID NO: 241 - protein, 331 aa, Enterococcus faecalis HIP11704; identical to SEQ ID NO: 235

SEQ ID NO: 242 - protein, 331 aa, Enterococcus faecalis DS5; identical to SEQ ID NO: 235

SEQ ID NO: 243 - protein, 331 aa, Enterococcus faecalis T1; identical to SEQ ID NO: 235

SEQ ID NO: 244 - protein, 331 aa, Enterococcus faecalis ATCC 29200; identical to SEQ ID NO: 235

SEQ ID NO: 245 - protein, 350 aa, Pedobacter sp. BAL39
AGIVIHLIYQSVGRSSEKGNNLIMDEIHRPGGGVPRQMAPVILITTVITHLFGGSAGREGTAVQIGGSIAGMFSRWFKLNEVDTKMLLTAGIAAGFGAVFGTPLTGAIFAMEVLAIGRIEYKALLPALIASVLGDLTVSAWGIHHTAYHIDLIEKSAYFLSEYLPVNLLLLSKVILASTLFGLASYLFAVMVHEIKAFFSKVCKIQWLIPVIGGLIIIGLTYAIGKPDYLSLGVDSEYQGAVTIPSAFQPGGADTWSWLWKTIYTTLTLGTGFKGGEVTPLFYIGATLGNALSTLLNAPVSLFAALGFIAVFAGATNTPLACTIMGIELFGSEYTMFFAVACFTAYFFSG

SEQ ID NO: 246 - protein, 331 aa, Enterococcus faecalis TX0411
GVVFTYFYTRFGKNASRGNNLVIEQGNGGEEDIPLRLIPLTLFGTITTHLFGGSVGREGTAVQMGGAIANAVGKVFKLSALEREVIIISGISAGFSSVFGTPLAGTVFGLEVLAIGKVRAEALFPSFFAGLFANFVTESFGVTHTHYPMGKIPTWSVDLFVKLFLASICFGLAGWVFSRSIVFLKKTYANWFANVYLRAFLGASIVVLFVVVLNNQRYLGLSLPLLEDAFAGNAQPFDFIGKLFFTVLSLGAGFQGGEVTPLFEIGATLGSSLAPLLHLSIPFLAGLGFIGVFSGATNTPIACFIMGIELFGSEAAVYFFMVCLISFMCSG

SEQ ID NO: 247 - protein, 331 aa, Enterococcus faecalis T8; identical to SEQ ID NO: 246

SEQ ID NO: 248 - protein, 331 aa, Enterococcus faecalis ATCC 4200
GVVFTYFYTRFGKNASRGNNLVIEQGNGGEEDIPLRLIPLTLFGTITTHLFGGSVGREGTAVQMGGAIANAVGKVFKLSALERQVIIISGISAGFSSVFGTPLAGTVFGLEVLAIGKVRAEALFPSFFAGLFANFVTESFGVTHTHYPMGKIPTWSVDLFVKLFLASICFGLAGWVFSRSIVFLKKTYANWFANVYLRAFLGASIVVLFVLVLKNQRYLGLSLPLLEDAFAGNAQPFDFVGKLFFTVLSLGAGFQGGEVTPLFEIGATLGSSLAPLLHLSIPFLAGLGFIGVFSGATNTPIACFIMGIELFGSEAAVYFFMVCLISFMCSG

SEQ ID NO: 249 - protein, 331 aa, Enterococcus faecalis TX1322
GVVFTYFYTRFGKNASRGNNLVIEQGNGGEEDIPLRLIPLTLFGTITTHLFGGSVGREGTAVQMGGAIANAVGKVFKLSALERQVIIISGISAGFSSVFGTPLAGTVFGLEVLAIGKVRAEALFPSFFAGLFANFVTESFGVTHTHYPMGKIPTWSVDLFVKLFLASICFGLAGWVFSRSIVFLKKTYANWFANVYLRAFLGASIVVLFVLVLNNQRYLGLSLPLLEDAFAGNAQPFDFVGKLFFTVLSLGAGFQGGEVTPLFEIGATLGSSLAPLLHLSIPFLAGLGFIGVFSGATNTPIACFIMGIELFGSEAAVYFFMVCLISFMCSG

SEQ ID NO: 250 - protein, 331 aa, Enterococcus faecalis E1Sol
GVVFTYFYTRFGKNASRGNNLVIEQGNGGEEDIPLRLIPLTLFGTITTHLFGGSVGREGTAVQMGGAIANAVGKVFKLSALERQVIIISGISAGFSSVFGTPLAGTVFGLEVLAIGKVRAEALFPSFFAGLFANFVTESFGVTHTHYPMGKIPTWSVELFVKLFLASICFGLAGWVFSRSIVFLKKTYANWFANVYLRAFLGAAIVVLFVLVLNNQRYLGLSLPLLEDAFTGNAQPFDFVGKLFFTVLSLGAGFQGGEVTPLFEIGATLGSSLAPLLHLSIPFLAGLGFIGVFSGATNTPIACFIMGIELFGSEAAVYFFMVCLISFMCSG

SEQ ID NO: 251 - protein, 331 aa, Enterococcus faecalis TX0860
GVVFTYFYTRFGKNASRGNNLVIEQGNGGEEDIPLRLIPLTLFGTITTHLFGGSVGREGTAVQMGGAIANAVGKVFKLSALERQVIIISGISAGFSSVFGTPLAGTVFGLEVLAIGKVRAEALFPSFFAGLFANFVTESFGVTHTHYPMGKIPTWSVELFVKLFLASICFGLAGWVFSRSIVFLKKTYANWFANVYLRAFLGASIVVLFVLVSNNQRYLGLSLPLLEDAFAGNAQPFDFVGKLFFTVLSLGAGFQGGEVTPLFEIGATLGSSLAPLLHLSIPFLAGLGFIGVFSGATNTPIACFIMGIELFGSEAAVYFFMVCLISFMCSG

SEQ ID NO: 252 - protein, 331 aa, Enterococcus faecalis T2; identical to SEQ ID NO: 251

SEQ ID NO: 253 - protein, 331 aa, Enterococcus faecalis CH188
GVVFTYFYTRFGKNASRGNNLVIEQGNGGEEDIPLRLIPLTLFGTITTHLFGGSVGREGTAVQMGGAIANAVGKVFKLSALERQVIIISGISAGFSSVFGTPLAGTVFGLEVLAIGKVRAEALFPSFFAGLFANFVTESFGVTHTHYPMGKIPTWSVELFVKLFLASICFGLAGWVFSRSIVFLKKTYANWFANVYLRAFLGAAIVVLFVLVLNNQRYLGLSLPLLEDAFAGNAQPFDFVGKLFFTVLSLGAGFQGGEVTPLFEIGATLGSSLAPLLHLSIPFLAGLGFIGVFSGATNTPIACFIMGIELFGSEAAVYFFMVCLISFMCSG

SEQ ID NO: 254 - protein, 331 aa, Enterococcus faecalis T3; identical to SEQ ID NO: 253

SEQ ID NO: 255 - protein, 331 aa, Enterococcus faecalis V583
GVVFTYFYTRFGKNASRGNNLVIEQGNGGEEDIPLRLIPLTLFGTITTHLFGGSVGREGTAVQMGGAIANAVGKVFKLSALERQVIIISGISAGFSSVFGTPLAGTVFGLEVLAVGKVRAEALFPSFFAGLFANFVTESFGVTHTHYPMGKIPTWSVELFVKLFLASICFGLAGWVFSRSIVFLKKTYANWFANVYLRAFLGAAIVVLFVLVLNNQRYLGLSLPLLEDAFAGNAQPFDFVGKLFFTVLSLGAGFQGGEVTPLFEIGATLGSSLAPLLHLSIPFLAGLGFIGVFSGATNTPIACFIMGIELFGSEAAVYFFMVCLISFMCSG

SEQ ID NO: 256 - protein, 331 aa, Enterococcus faecalis HH22; identical to SEQ ID NO: 255

SEQ ID NO: 257 - protein, 331 aa, Enterococcus faecalis TX0109
GVVFTYFYTRFGKNASRGNNLVIEQGNGGEEDIPLRLIPLTLFGTITTHLFGGSVGREGTAVQMGGAIANAVGKVFKLSALERQVIIISGISAGFSSVFGTPLAGTVFGLEVLAIGKVRAEALFPSFFAGLFANFVTESFGVTHTHYPMGKIPTWSVDLFVKLFLASICFGLAGWVFSRSIVFLKKAYANWFANVYLRAFLGAAIVVLFVLVLNNQRYLGLSLPLLEDAFAGNAQPFDFVGKLFFTVLSLGAGFQGGEVTPLFEIGATLGSSLAPLLHLSIPFLAGLGFIGVFSGATNTPIACFIMGIELFGSEAAVYFFMVCLISFMCSG

SEQ ID NO: 258 - protein, 331 aa, Enterococcus faecalis S613; identical to SEQ ID NO: 257

SEQ ID NO: 259 - protein, 331 aa, Enterococcus faecalis R712; identical to SEQ ID NO: 257

SEQ ID NO: 260 - protein, 331 aa, Enterococcus faecalis Merz96; identical to SEQ ID NO: 257

SEQ ID NO: 261 - protein, 335 aa, Acidobacterium sp. MP5ACTX9
AGWLVGEMYKRLGTSVEAGNNLILEEIHSPTATIPVRMTPLILIGTFMTHLFGGSAGREGTAIQTGASLADQLARPFRLSPRDRRILLMAGISAGFASVFGTPLAGAIFGLEVLAIGTLSYEAIAPCFMAAFVGDLVTRAWKVHHTVYTVTDVPTMSIRGVAYAMIAGAIFGLAGMCFARLTHAVSHLAKKYIVNPPLRPVAGGLLVTIAVFGLGTSHTLKYIGLGIPTIVAAFHSRLPAYDFAAKSIFTAITLGAGFKGGEVTPLFFIGSTLGNALSRLIPLPSSLMAGMGFVAVFAGAANTPIASTLMAVELFGGEAGAYAGIACVISYLFSG

SEQ ID NO: 262 - protein, 331 aa, Enterococcus faecalis D6
GVVFTYFYTRFGKNASRGNNLVIEQGNGGEEDIPLRLIPLTLFGTITTHLFGGSVGREGTAVQMGGAIANAVGKVFKLSALEREVIIISGISAGFSSVFGTPLAGTVFGLEVLAIGKVRAEALFPSFFAGLFANFVTESFGVTHTHYPMGKIPTWSVELFVKLFLASICFGLAGWVFSRSIVFLKKTYANWFANVYLRAFLGAAIVVLFVLVLNNQRYLGLSLPLLEDAFAGNAQPFDFVGKLFFTVLSLGAGFQGGEVTPLFEIGATLGSSLAPLLHLSIPFLAGLGFIGVFSGATNTPIACFIMGIELFGSEAAVYFFMVCLISFMCSG

SEQ ID NO: 263 - protein, 331 aa, Enterococcus faecalis TX4248
GVVFTYFYTRFGKNASRGNNLVIEQGNGGEEDIPLRLIPLTLFGTITMHLFGGSVGREGTAVQMGGAIANAVGKVFKLSALERQVIIISGISAGFSSVFGTPLAGTVFGLEVLAIGKVRAEALFPSFFAGLFANFVTESFGVTHTHYPMGKIPTWSVELFVKLFLASICFGLAGWVFSRSIVFLKKTYANWFANVYLRAFLGASIVVLFVLVLNNQRYLGLSLPLLEDAFAGNAQPFDFVGKLFFTVLSLGAGFQGGEVTPLFEIGATLGSSLAPLLHLSIPFLAGLGFIGVFSGATNTPIACFIMGIELFGSEAAVYFFMVCLISFMCSG

SEQ ID NO: 264 - protein, 332 aa, Enterococcus faecalis PC1.1
GVVFTYFYTRFGKNASRGNNLVIEQGNGGEEDIPLRLIPLTLFGTITMHLFGGSVGREGTAVQMGGAIANAVGKVFKLSALERQVIIISGISAGFSSVFGTPLAGTVFGLEVLAIGKVRAEALFPSFFAGLFANFVTESFGVTHTHYPMGKIPTWSVELFVKLFLASICFGLAGWVFSRSIVFLKKTYANWFANVYLRAFLGASIVVLFVLVLNNQRYLGLSLPLLEDAFAGNAQPFDFVGKLFFTVLSLGAGFQGGEVTPLFEIGATLGSSLAPLLHLSIPFLAGLGFIGVFSGATNTPIACFIMGIELFGSEAAVYFFMVCLISFMCSGK

SEQ ID NO: 265 - protein, 331 aa, Enterococcus faecalis JH1; identical to SEQ ID NO: 263

SEQ ID NO: 266 - protein, 347 aa, Agrobacterium radiobacter K84
AGFLMVLAYQRFGRGAEGGNNLIVEQIHEPGGGVPLRMAPFILVSTVLTHLVGGSAGREGTAVQLGGSIASAFARFFRLSHAEVRILLMAGIAAGFGAVFGTPIAGAVFALEVLTIGRMQYEALIPSLVAAIAADWTCHAWGIEHVQYHIAYLAGTPASTFHLDALLLLKVGIAGVLFGLMARCFSEISHRMSAVFKKICAYAPLRSVIASIVLIGLVYALGTREYLGLGVWSPNPGDATIPGFFDPARVDYWGWFWKAVFTIVTLSSGFKGGEVTPLFFIGAALGNAIAAILGAPVDLFAALGFVAVFAGATNTPLACMIMGIELFGATHTVYLAVACFLAYICSG

SEQ ID NO: 267 - protein, 331 aa, Enterococcus faecalis Fly1
GVVFTYFYTRFGKNASRGNNLVIEQGNGGEEDIPLRLIPLTLFGTITTHLFGGSVGREGTAVQMGGAIANAVGKIFKLSALERQVIIISGISAGFSSVFGTPLAGTVFGLEVLAIGKVRAEALFPSFFAGLFANFVTESFGVTHTHYPMGKIPTWSVELFVKLFLASICFGLAGWVFSRSIVFLKKTYANWFANVYLRAFLGAAIVVLFVLVLNNQRYLGLSLPLLEDAFAGNAQPFDFVGKLFFTVLSLGAGFQGGEVTPLFEIGATLGSSLAPLLHLSIPFLAGLGFIGVFSGATNTPIACFIMGIELFGSEAAVYFFMVCLISFMCSG

SEQ ID NO: 268 - protein, 345 aa, Methylobacterium extorquens AM1
GGFAVGLLYFLFGKSVEGGNNLIVEEIHEPDGGVPLRMTPLIFLGTIVTHLFGGSAGREGTAVQMGGSLASAFGRMFGVDAAGVRVLLMAGIAAGFGAVFGTPIAGAVFALEVLAVGRVEYAALVPCLLAAVVGDWTCQAWGIHHALYHVGFLAGTAKALTVEPVLLAKVALAGVAFGLVGLLFAEANHVLGGWLKRLVPYGPLRPVIGGLAVIGLVYALGTRDYLGLGVSAAEPGGLTITGFFGPDIHPWSWALKILFTVVTLSAGFKGGEVTPLFFIGAALGNALAGVLGAPVDLFAALGFVAVFAGAANTPLACTLMGIELFGATHGVYLAVACFIAYLCSG

SEQ ID NO: 269 - protein, 329 aa, Streptococcus suis 05HAS68
AGGVIVFIYQKWGREVQAGMGLVFKAGQGEKAQISPVLIPLIISTTWLSHLVGASVGREGVAVQLGASLSHWLKKHGFTHLPKDMITKIGMAAGFAGLFQTPLAAIFFAIEVLIVGQYSWTSLPYCLVAAFTASTTSHLLGLEKFSHTVATTSFYFTDSFKWLFIALCFGFIGNLFAWFLAQAKSISTRWLPNPYIKIAIMGVGLTVLLFFFHQGHYTGLGTNLIDASLAGEQVFAFDWLLKLLLTCLCLAAGFQGGEVTPLFAIGASSGVVLAGLLGLPTELVAALGYCAVFGTATNTLLAPLFISYEVFGANILPYAIPVLAIAYLI

SEQ ID NO: 270 - protein, 348 aa, Agrobacterium vitis S4
AGFAMVWAYQRFGKAAEGGNNLIVEQIHEPGGGVPLRMAPFILVSTVLTHLVGGSAGREGTAVQLGGSLASAFAKLFRLAQGDVRILLMAGIAAGFGAVFGTPIAGAVFALEVLTIGRMQYEALLPALLAAVVADWTCQAWGASHTHYVIAYLKNMPDSGGFHLDALIMLKVVFAGAVFGLAAHGFAEISHLAGAAYKALLPSAPLRPVLASAILLALVWLLGTRDYLGLGVWSPHPGDVTILSFFRPDHVDAWSWAWKALFTVVTLSAGFKGGEVTPLFFIGAGLGNALAGLTGAPTDLFAGLGFVAVFAGATNTPLACMIMGLELFGATHAVYLAVACFTAYLTSG

SEQ ID NO: 271 - protein, 331 aa, Enterococcus faecium E1162
GALFAYLYAYHGGLSSRGNNLVIDQGNGGEEKIPLRLIPLTLFGTITTHLFGGSVGREGTAVQMGGALADNIAHLFRLDKAEREILVISGISAGFSSVFGTPLAGTLFGLEVLAIGKVRTEAIFPSFFAALFANFMTESYGVSHLHYQMGVIPEWSMLLFFKVFVAGIAFGLIGWVFSRSIVFLKARYAQWIPHPVWRNTIGGAVVVAAALILQTQRYLGLSLPLLQESFNGQAHAYDFIGKLFFTVLSLGAGYQGGEVTPLFEIGATLGAVLAPLLHVSVPFLAGLGFIGVFSGATNTPIACFVMGIELFGSQAAAYFFMICLISFMCSG

SEQ ID NO: 272 - protein, 331 aa, Enterococcus faecium C68; identical to SEQ ID NO: 271

SEQ ID NO: 273 - protein, 331 aa, Enterococcus faecium 1,231,410; identical to SEQ ID NO: 271

SEQ ID NO: 274 - protein, 333 aa, Eubacterium ventriosum ATCC 27560
AGLFIVWMYSYFSKVSLKGMTLVFEAGQNKRDSIPMALVPLVMIGTWITHLFGGSAGREGVAVQIGATLSHYMGRKLKTPDNSRIMLITGMAAGFGGLFQTPLAATFFAMEVIVAGYMDYQALLPAITAAFVASFTSHSLGLEKFAVELNETINMSDAKTVIIIIILGLAFGIVGRIFSYLLQLLKKIMAEKIVNPYLRIGLVSIPLAIILLLLWQGRYSGLGTNLILNAFNNGEIFLADWLLKLLLTVLTLSIGFQGGEVTPLFSIGASLGIILGSFLGISPMLCAALGYAAVFGSATNTLMAPIMLGIEVFGGNNMLASVVVCSLAYVVNG

SEQ ID NO: 275 - protein, 331 aa, Enterococcus faecalis TX0104
GVVFTYFYTRFGKNAGRGNNLVIEQGNGGEEDIPLRLIPLTLFGTITTHLFGGSVGREGTAVQMGGAIANAVGKIFKLSALERQVIIISGISAGFSSVFGTPLAGTVFGLEVLAIGKVRAEALFPSFFAGLFANFVTESFGVTHTHYPMGKIPTWSVELFVKLFLASICFGLAGWVFSRSIVFLKKTYANWFANVYLRAFLGASIVVLFVLILNNQRYLGLSLPLLEDAFAGNAQPFDFVGKLFFTVLSLGAGFQGGEVTPLFEIGATLGSSLAPLLHLSIPFLAGLGFIGVFSGATNTPIACFIMGIELFGSEAAVYFFMVCLISFMCSG

SEQ ID NO: 276 - protein, 332 aa, Leeuwenhoekiella blandensis MED217
GGFLVGLSYHLYGNSVVKGNNLLLEEFHTPKKVIPFKMAPLVLFGTIATHLFGGSAGREGTAVQIGGAVADQFTKIFKLNNQDRKILLIAGISAGFASVFGTPLAGGIFALEVLILGRIRLDAIVPSFLAAVLADYFCQAWNVGHTHYHINSIAEMNPANLLWALLAGIIFGLVSMLFSKSTHFWSSQFKKYIKYPPLRPFIGGVVIAIAVYLIGTTKYIGLGVPTIVDSFSEAMNKYDFLVKVLFTSFTLGAGFKGGEVTPLFYIGATLGNALIWFIPLPMDLLAGMGFVAVFAGATNTPIACTIMGIELFGIESGVFIAIACSTAYLFSG

SEQ ID NO: 277 - protein, 331 aa, Enterococcus faecium E1071
GALFAYLYAYHGGLSSRGNNLVIDQGNGGEEKIPLRLIPLTLFGTITTHLFGGSVGREGTAVQMGGALADNIAHLFRLDKAEREILVISGISAGFSSVFGTPLAGTLFGLEVLAIGKVRTEAIFPSFFAALFANFMTESYGVSHLHYQMGVIPEWSMLLFFKVFVAGIAFGLIGWVFSRSIVFLKARYAQWIPHPVWRNTIGGAVVVAAALILQTQRYLGLSLPLLQESFNGQAHAYDFIGKLFFTVLSLGAGYQGGEVTPLFEIGATLGAVLAPLLHVSVPFLAGLGFIGVFSGATNTPIACFVMGIELFGSQAAVYFFMICLISFMCSG

SEQ ID NO: 278 - protein, 332 aa, Clostridium botulinum E1 str. 'BoNT E Beluga'
GGALVSFLYSKYGKSSSRGNNLIIEKINTSNGEIPLRMASLVFIGTFITHLFGGSAGREGTGVQIGSSISEGIGHLFKLDKVDTKIILMCGISSGFSSVFGTPLAGTMFGLEVAALGTMSYQALIPCFTSAFVGNIVTTAFGVSHSHYRILEVPSITYIVVFKVIVAAILFGLVSKFFSEFTHKLKDIFSSTFKNSAIKSMVGGFIVIILTYLIGTRDYLGLSLPLINNSFTQNVSPFAFFNKLIFTSFTLGTGFQGGEVTPLFVIGSTLGNTLSTILHISPSFLAALGLIGVFAGATNSPITSFILGLELFGAQGIEFMFMTCAISYLFSG

SEQ ID NO: 279 - protein, 331 aa, Enterococcus faecium 1,141,733
GALFAYLYAYHGGLSSRGNNLVIDQGNGGEEKIPLRLIPLTLFGTITTHLFGGSVGREGTAVQMGGALADNIAHLFRLDKAEREILVISGISAGFSSVFGTPLAGTLFGLEVLAIGKVRTEAIFPSFFAALFANFMTESYGVSHLHYQMGVIPEWSMLLFFKVFVAGIAFGLIGWVFSRSIVFLKARYAQWIPHPVWRNTIGGAVVVAAALILQTQRYLGLSLPLLQESFNGQAHAYDFIGKLFFTVLSLGAGYQGGEVTPLFEIGATLGAVLAPLLQVSVPFLAGLGFIGVFSGATNTPIACFVMGIELFGSQAAVYFFMICLISFMCSG

SEQ ID NO: 280 - protein, 332 aa, Clostridium botulinum E3 str. Alaska E43
GGALVSFLYSKYGKSSSRGNNLIIEKINTSNGEIPLRMASLVFIGTFITHLFGGSAGREGTGVQIGSSISEGISHLFKLDKVDTKIILMCGISSGFSSVFGTPLAGTMFGLEVAALGTMSYQALIPCFTSAFVGNIVTTAFGVSHSHYSILEVPSITYIVVFKVIVAAILFGLVSKFFSEFTHKLKDIFSSTFKNSAIKSMVGGFIVIILTYLIGTRDYLGLSLPLINNSFTENVSPFAFFNKLIFTSFTLGTGFQGGEVTPLFVIGSTLGNTLSTILHISPSFLAALGLIGVFAGATNSPITSFILGLELFGAQGIEFMFMTCAISYLFSG

SEQ ID NO: 281 - protein, 331 aa, Enterococcus faecium E980
GALFAYLYAYHGGLSSRGNNLVIDQGNGGEEKIPLRLIPLTLFGTITTHLFGGSVGREGTAVQMGGALADNIARLFRVDKAEREILIISGISAGFSSVFGTPLAGTLFGLEVLTIGKVRTEAIFPSFFAALFANFMTESYGVSHLHYQMGVIPEWSMLLFFKVFVAGIAFGLIGWVFSRSIVFLKARYAQWIPHPVWRNTIGGAVVVAAALILQTQRYLGLSLPLLQESFNGQAHAYDFIGKLFFTVLSLGAGYQGGEVTPLFEIGATLGAALAPLLHVSVPFLAGLGFIGVFSGATNTPIACFVMGIELFGSQAAVYFFMICLISFMCSG

SEQ ID NO: 282 - protein, 333 aa, Oscillatoria sp. PCC 6506
AGFLSGWIYHQYGKQVEAGNNLLLEEIHNPKNIIPLRMAPMVLLGTDITHLFGGSAGREGTALQIAASLADQLTKIFHFKHANRRILLMSALSGGFASVFGTPLAGTIFGLEVLAIGTIQHDALFPCLVAAVVGDRITLVLGLHHTAYRHAPFVPTITPMALISAIIAGAIFGIVAMIFAKLTHKISHFFKAKISYPPLRPAIGGTIVVLSVWAMGSSKYIGLGIPTIVDAFYSQLPPWDFAAKIALTALTLGAGFKGGEVTPLFFIGATLGNALSLILALPAPLLAGMGFVAVFGGAANTPIASTLMGIELFGLESGVFIAIACVMSYVFSG

SEQ ID NO: 283 - protein, 331 aa, Enterococcus faecium Com12
GALFAYLYAYHGGLSSRGNNLVIDQGNGGEENIPLRLIPLTLFGTITTHLFGGSVGREGTAVQMGGALADNIARLFRLDKAEREILIISGISAGFSSVFGTPLAGTLFGLEVLAIGKVRTEAIFPSFFAALFANFMTESYGVSHLHYQMGVIPEWSMLLFFKVFVAGIAFGLIGWVFSRSIVFLKARYAQWIPHPVWRNTIGGAVVVAAALILQTQRYLGLSLPLLQESFNGQAHAYDFIGKLFFTVLSLGAGYQGGEVTPLFETGATLGAALAPLLHVSVPFLAGLGFIGVFSGATNTPIACFVMGIELFGSQAAVYFFMICLISFMCSG

SEQ ID NO: 284 - protein, 331 aa, Enterococcus faecium Com15
GALFAYLYAYHGGLSSRGNNLVIDQGNGGEEKIPLRLIPLTLFGTITTHLFGGSVGREGTAVQMGGALADNIAHLFRLDKAEREILIISGISAGFSSVFGTPLAGTLFGLEVLTIGKVRTEAIFPSFFAALFANFMTESYGVSHLHYQMGVIPEWSMLLFFKVFVAGIAFGLIGWVFSRSIVFLKARYAQWIPHPVWRNTIGGAVVVAAALILQTQRYLGLSLPLLQESFNEQAHAYDFIGKLFFTVLSLGAGYQGGEVTPLFEIGATLGAVLAPLLHVSVPFLVGLGFIGVFSGATNTPIACFVMGIELFGSQAAAYFFMICLISFMCSG

SEQ ID NO: 285 - protein, 331 aa, Enterococcus faecium DO
GALFAYLYAYHGGLSSRGNNLVIDQGNGGEEKIPLRLIPLTLFGTITTHLFGGSVGREGTAVQMGGALADNTARLFRLDKSEREILIISGISAGFSSVFGTPLAGTLFGLEVLAIGKVRTEAIFPSFFAALFANFMTESYGVSHLHYQMGVIPEWSMLLFFKVFVAGIAFGLIGWVFSRSIVFLKARYAQWIPHPVCRNTIGGAVVVAAALILQTQRYLGLSLPLLQESFNGQAHVYDFIGKLFFTVLSLGAGYQGGEVTPLFEIGATLGAALAPLLHVSVPFLAGLGFIGVFSGATNTPIACFVMGIELFGSQAAVYFFMICLISFMCSG

SEQ ID NO: 286 - protein, 331 aa, Enterococcus faecium DO; identical to SEQ ID NO: 285

SEQ ID NO: 287 - protein, 331 aa, Enterococcus faecium 1,231,408; identical to SEQ ID NO: 285

SEQ ID NO: 288 - protein, 331 aa, Enterococcus faecium 1,230,933; identical to SEQ ID NO: 285

SEQ ID NO: 289 - protein, 349 aa, Coraliomargarita akajimensis DSM 45221
GVGIVWLYRRFGKNSEAGNNLIMDEIHTPGGGIPFRMAPLVLLTTVLTHLFGGSAGREGTAVQMGGSTAEYFAQKLGLGKEDKRILLMAGMAAGFGAVFGTPVTGAIFALEVLAVGRIKYDALLPCLFASLIADITCNSLAVHHTHYAIGYSAREAMEHFGGIDFDLILLLKVLLASACFGLASFFFAELSHGLKALSQAFLKPWWLPPVLAAVLVLGISYCLGTWDYLGLGVYSSQEGGVSIVNAFEAGGATSFSWFWKLLLTAITLSFGFKGGEVTPLFFIGATLGNALAVWMGAPIDLLAGLGFIAVFAGATNTPLACTLMGVELFGAENLIYYAIACFTAYYFSG

SEQ ID NO: 290 - protein, 349 aa, Pedobacter sp. BAL39
GILIHFIYQSVGKSSEKGNNLIIEEIHQPGGGVPIQMAPIVLMTTIVTHLFGGSAGREGTAVQIGGSIAGLFGRWFKLNEADTKVILTAGIAAGFGAVFGTPLTGAIFAIEVLTIGRMKYDALLPALIASFIGDLSVTLCGIHHTAYHIDPIITNSNFLSAYYPVNVVLIMKITFSAVCFGLSSYLFVFLIHQIKAFSIKMIRVQWLIPVFGAAVLILMTSLLGKPDYLGLGVESEYPGAVTIPAAFQIGGADTWSWLWKNIFTAVTLGTGFKGGEVTPLFYMGATLGNVLSVVLHAPVSLFAALGFIAVFSGATKTPFACTLMGAELFGIQYLLFFALACFIAYWCSG

SEQ ID NO: 291 - protein, 331 aa, Enterococcus faecium E1039
GALFAYLYAYHGGLSSRGNNLVIDQGNGGEEKIPLRLIPLTLFGTITTHLFGGSVGREGTAVQMGGALADNTARLFRLDKSEREILIISGISAGFSSVFGTPLAGTLFGLEVLAIGKVRTEAIFPSFFAALFANFMTESYGVSHLHYQMGVIPEWSMLLFFKVFVAGIAFGLIGWVFSRSIVFLKARYAQWIPHPVWRNTIGGAVVVAAALILQTQRYLGLSLPLLQESFNGQAHVYDFIGKLFFTVLSLGAGYQGGEVTPLFEIGATLGAALAPLLHVSVPFLAGLGFIGVFSGATNTPIACFVMGIELFGSQAAVYFFMICLISFMCSG

SEQ ID NO: 292 - protein, 332 aa, Bacteroides coprophilus DSM 18228
AGLLIGLMYHYLAGTAARGNNYLIEEIRSPHDIIPFRMAPLVYIGTVLTHLFGGSAGREGTGVQMGGAIADQFSRLFHLHRRDHKVMVLIGISAGFASVFGTPLAGAVFGLEVIVVGRMRYEAILPAFLSAAFAHLTCYAWGVAHTQYAIPEVPALNVANILWVALAGVLFGLVAMLFSRSIGFWGGLARRYVSYPPLRPFWGGILIALAVWLLGTTKYIGLGVPVIVASFTEQQMWYDFLLKLIFTTFTIGVGFKGGEVTPLFFVGATLGSALSAVVPLPMALLAGLGFVAVFAGATNTPIACTLMGIELFGAEAGLYLGIACVIAYLFSG

SEQ ID NO: 293 - protein, 331 aa, Enterococcus faecium U0317
GALFAYLYAYHGGLSSRGNNLVIDQGNGGEEKIPLRLIPLTLFGTITTHLFGGSVGREGTAVQMGGALADNTARLFRLDKAEREILIISGISAGFSSVFGTPLAGTLFGLEVLAIGKVRTEAIFPSFFAALFANFMTESYGVSHLHYQMGVIPEWSMLLFFKVFVAGIAFGLIGWVFSRSIVFLKARYAQWIPHPVWRNTIGGAVVVAAALILQTQRYLGLSLPLLQESFNGQAHVYDFIGKLFFTVLSLGAGYQGGEVTPLFEIGATLGAALAPLLHVSVPFLAGLGFIGVFSGATNTPIACFVMGIELFGSQAAVYFFMICLISFMCSG

SEQ ID NO: 294 - protein, 331 aa, Enterococcus faecium D344SRF; identical to SEQ ID NO: 291

SEQ ID NO: 295 - protein, 331 aa, Enterococcus faecium TC 6; identical to SEQ ID NO: 291

SEQ ID NO: 296 - protein, 331 aa, Enterococcus faecium 1,231,501; identical to SEQ ID NO: 291

SEQ ID NO: 297 - protein, 332 aa, Bacteroides coprocola DSM 17136
AGLVIGLMYHYLAGTASRGNNFLIEEIRSPHDIIPFRMAPLVYIGTVLTHLFGGSAGREGTGVQMGGAIADRFSKLFRLPRRDHRVMVAIGISAGFASIFGTPLAGAVFGLEVIIVGRMRYESILPVFLSAAFAHLTCHSWGVEHTLYPAPVVPELGVSNILWVALSGIVFGVVAMAFSRSIGFWGGVAKKFISYPPLRPVAGGIIIALAVWLLGTTKYIGLGVPTIVASFSEQQMWYDFLLKLIFTTFTIGVGFKGGEVTPLFFVGATLGSALSFIIPLPMSLLAGLGFVAVFAGATNTPIACTFMGIELFGIEPGIYLGIACVVAYLFSG

SEQ ID NO: 298 - protein, 331 aa, Enterococcus faecium E1679; identical to SEQ ID NO: 291

SEQ ID NO: 299 - protein, 346 aa, Pelobacter propionicus DSM 2379
AGAAISLLYSRIGNGAEGGNNLLMDAIHGSENGDSGIVVPRRMAPLILVATIISHLFGGSVGREGTAVQMGGSIAAAIGRWFRLNLGDFRILLMAGIAAGFGAVFGTPLTGAVFAMEVLAVGRMNYDALIPCLAAAIIGDQACLAWGLHHSRYSVAAVAPEIVGPLTLKVILAAIAFGLASVLFAELIHGISHIFKRTVSRPWLRPVLGGLLVIALTYLLGTRDYLGLGVSSPDPQAVTIISCFSANGATPWSWWWKLLFTVITLGSGFKGGEVTPLFFIGAALGNALALLMNAPVELFAALGFVAVFAGASNTPLACTLMGIELFGASCSLYFAIACFLSYLCSG

SEQ ID NO: 300 - protein, 348 aa, Gluconobacter oxydans 621H
AGVAVGLCYFWFGRDVEAGANLIVDEIHEPGAGVQLRMAPFVLIATVVSHLFGASVGREGTAIQVGGSLASATARLFRLRAPETCVLLTCGIAAGFGAVFGTPIAGAVFALEVLTLGRLDYRFLLPAAMSSIIADWACRAWGIHHASYPLVFQGTLNSDGSLSHVDIMLVVRVAIAALAFGLLSRVFAESVHLLAAFMKKLCKTPWLRPAIGGILTILLVMIVGNRDYLGLGVLPAEPGGASIVSFFGPTIYPWSWFWKLVFTVTVLATGFKGGEVTPLFFLGAASGNILAFLLHVPVDLLAAVGFVSVFAGAANTPLACTLMGVELFGAGDIVYFATGCFVAYACSG

SEQ ID NO: 301 - protein, 331 aa, Clostridium botulinum B str. Eklund 17B
GAFVSFLYSKYGKSSSKGNNLIIDKINTNNGNIPMRMASLVFLGTFVTHLLGGSAGREGTGVQIGSSISEGVGRLLKLDKVDTKIILMCGISSGFSSVFGTPLAGTIFGLEVATLGTMSYQALIPCFTSAFIGNIVTTAFGVHHSHYSILEVPTITYFVVLKIIIAAILFGLVSKLFSELTHKLKDIFSSRFENAAIKSMVGGFIIIILTYLIGTRDYLGLSLPLINNSFTEQVSPFAFFNKLIFTSFTLGTGFQGGEVTPLFVIGSTFGNTLSNILHISPSFLAALGLIGVFAGATNAPITSFILGLELFGAQGIEFMFMTCAISYLFSG

SEQ ID NO: 302 - protein, 331 aa, Enterococcus faecium PC4.1
GALFAYLYAYHGGLSSRGNNLVIDQGNGGEENIPLRLIPLTLFGTITTHLFGGSVGREGTAVQMGGALADNIARLFRLDKAEREILIISGISAGFSSVFGTPLAGTLFGLEVLAIGKVRTEAIFPSFFAALFANFMTESYGVYHLHYQMGVIPEWSMLLFFKVFVAGIAFGLIGWVFSRSIVFLKARYAQWIPHPVWRNTIGGAVVVAAALILQTQRYLGLSLPLLQESFNGQAHAYDFIGKLFFTVLSLGAGYQGGEVTPLFETGATLGAALAPLLHVSVPFLAGLGFIGVFSGATNTPIACFVMGIELFGSQAAVYFFMICLISFMCSG

SEQ ID NO: 303 - protein, 348 aa, Gluconacetobacter hansenii ATCC 23769
AGVGVGLTYHHLGRCAEGGNNLIIDQIHEPGGGVPLRMAPLVLVATVISHLFGASVGREGTAVQIGGSIASGFGRLFRLDHDAVRIVLVSGVAAGFGAVFGTPIAGAIFALEVLSIGQINYRPLLPAAFSSILADWVCHAWGIHHTSYHVASGIIPDWGGSVFHTHPALLIKVGLAAICFGLTSLLFAEGIHRLTPLVRRACPVPWLRPAIGGVATILLVYLVGSRDYLGLGVVSMGHDAPSIVNFFHAGDYTWSWLYKLLFTVVVLATGYKGGEVTPLFFIGAGLGNTLSGILGVPADLLASVGFVAVFAGAANTPLACTFMGVELFGATDIVYIATGCFVAYLCSG

SEQ ID NO: 304 - protein, 331 aa, Enterococcus faecium TX1330; identical to SEQ ID NO: 283

SEQ ID NO: 305 - protein, 331 aa, Enterococcus faecium E1636
GALFAYLYAYYGGLSSRGNNLVIDQGNGGEEKIPLRLIPLTLFGTITTHLFGGSVGREGTAVQMGGALADNTARLFRLDKAEREILIISGISAGFSSVFGTPLAGTLFGLEVLAIGKVRTEAIFPSFFAALFANFMTESYGVSHLHYQMGVIPEWSMLLFFKVFVAGIAFGLMGWAFSRSIVFLKARYAQWIPHPVWRNTIGGAVVVAAALILQTQRYLGLSLPLLQESFNGQAHVYDFIGKLFFTVLSLGAGYQGGEVTPLFEIGATLGAALAPLLHVSVPFLAGLGFIGVFSGATNTPIACFVMGIELFGSQAAVYFFMICLISFMCSG

SEQ ID NO: 306 - protein, 331 aa, Enterococcus faecium 1,231,502
GALFAYLYAYHGGLSSRGNNLVIDQGNGGEEKIPLRLITLTLFGTITTHLFGGSVGREGTAVQMGGSLADNTARLFRLDKAEREILIISGISAGFSSVFGTPLAGTLFGLEVLAIGKVRTEAIFPSFFAALFANFMTESYGVSHLHYQMGVIPEWSMLLFFKVFVAGIAFGLIGWVFSRSIVFLKARYAQWIPHPVWRNTIGGAVVVAAALILQTQRYLGLSLPLLQESFNGQAHVYDFIGKLFFTVLSLGAGYQGGEVTPLFEIGATLGAALAPLLHVSVPFLAGLGFIGVFSGATNTPIACFVMGIELFGSQAAVYFFMICLISFMCSG

SEQ ID NO: 307 - protein, 332 aa, Clostridium botulinum D str. 1873
GGVLVSFLYYKYGSNSSKGNNLIIEKINEGCEDIPLRMTPLVFFGTVVTHLLGGSAGREGTGVQIGASIGENIGKLLKLNKYENRIIIMAGVSGGFSAIFGTPLAGTIFGLEVSVIGKMSYEALIPCLAASILGNSVVSFLGIKHSHYIIKEIPNLSIISAFKIVLASIVFGLISRLFSKLTHKLKYIFSKLFKNIFIKSFIGGIFVIVLTLIIGDYKYLGLSLPLMENAFKGHVHPMDFLGKLVFTSVTLGSGYQGGEVTPLFVIGSTLGSSLSALLNLSPSFLASLGLISVFTGATNTPIASFILGIEMFGSKGAIYMLIACSISYTFSG

SEQ ID NO: 308 - protein, 332 aa, Clostridium botulinum; identical to SEQ ID NO: 307

SEQ ID NO: 309 - protein, 333 aa, Clostridium cellulovorans 743B
AGAFVSFLYSKYGKTSSQGNNLILDQIHGGDNGIPLRMAPLVFIGTIITHLFGGSAGREGTAVQIGGSIAEYIGKILKLDKTDRRIILMCGISSGFGSVFGTPLAGTIFGMEVIAIGTMEYSALIPCFIASFVGNLVTTVLGAKHSHYALSGIPELSTMVLLKVIIASLLFGLVSILFSEGIHSCKKIFSKLFKNPMIKSIIGGVIIILLTLLIGTREYLGLGLPYISASFNEGVPKLAFLGKIIFTSITLGTGFQGGEVTPFFFVGSTFGNALGGILDLSPIFLAGLGLVAVFCGATNTPIASFFLGLELFHGEAVIYLFIACIISYLFSGY

SEQ ID NO: 310 - protein, 332 aa, Clostridium cellulovorans 743B
AGAFVSFLYSKYGKTSSQGNNLILDQIHGGDNGIPLRMAPLVFIGTIITHLFGGSAGREGTAVQIGGSIAEYIGKILKLDKTDRRIILMCGISSGFGSVFGTPLAGTIFGMEVIAIGTMEYSALIPCFIASFVGNLVTTVLGAKHSHYALSGIPELSTMVLLKVIIASLLFGLVSILFSEGIHSCKKIFSKLFKNPMIKSIIGGVIIILLTLLIGTREYLGLGLPYISASFNEGVPKLAFLGKIIFTSITLGTGFQGGEVTPFFFVGSTFGNALGGILDLSPIFLAGLGLVAVFCGATNTPIASFFLGLELFHGEAVIYLFIACIISYLFSG

SEQ ID NO: 311 - protein, 359 aa, Blastopirellula marina DSM 3645
AGIASGLMYHYLGREAEAGNNLIMEQIHQPGGGVPLRMAPLVLIGTLITHLFGGSAGREGTAVQMGGSLAGVLGRLLKLTPDETRILLSAGVAAGFGAVFGTPLTGAIFAVEVIAIGKMSYKALIPCLLASVIGDQVNTAWGIGHTHYHIGFAAEISSSLSAVSLDWALTGKVAIAAIFFGLASVLFAELTHAISGTAKRFIAIPWLRPAVGGCVVIALVWLLGTRDYLGLGVTPHPPDSGMICIESCFQPGGADWMSWWWKLLFTAVTVGSGFKGGEVTPLFFIGAALGNVTGVMLGAPVDLMAGLGFVAVFAGATNTPLACTIMAIELFGPGNGELLSSGFVVYAAIACFLSYFLSG

SEQ ID NO: 312 - protein, 333 aa, Polaribacter irgensii 23-P
GGLFIGLSYHYYGESVVKGNNLLLEEYHTPKKTIPFKMVPLVFLGTIITHLFGGSAGREGTAVQIGGAIADQFTKIFKLSNLDRKILLIAGISAGFSAVFGTPLAGAIFALEVLLIGRVKYDALLPSFLAAIFANYFCTVWQISNHTHYTISTVAELTPISVLWSLFAGIIFGLVSLLFSKSTHLWTGLFKKYISYPPLRPVIGGIFLAITVYLMGTTKYIGLGIPTIVDAFNIDLNSHDFFLKLILTSFTLGAGFKGGEVTPLFFIGATLGNVLIWFIPLPMPLLAGMGFVAVFAGATNTPIACTIMGIELFGIESGVFIALACTTSYLFSG

SEQ ID NO: 313 - protein, 330 aa, Eubacterium biforme DSM 3989
AGLAIVFLFDHWGRISRKGMGLVFEVDQGKSDWIPLRMAPFMVVSTWITHFFGGSAGREGVAMQIGATVSHYFGKYFRFKNSGVIFMVAGMAAGFAGLFGTPITAIFFALEVLVAGTLKYRAMSCAIPASFTAAYVSGLFGLHKSTFKIGNVAELNMELSIKLLVLGILFGMVGGLFAYFLKHTKAFVTNKITNPYKRIFMMGIIVAILLFVFGKCRYSGVGENLIVGSFTSEKIYSYDWILKFILTILTLSAGFQGGEVTPLFAIGSSLGVIIAPVFGLNPLFVASLGYCSVFGAATNTFLAPIAIGMEVFGYQYFPFFFVVCAISYIV

SEQ ID NO: 314 - protein, 333 aa, Roseburia intestinalis L1-82
AGLLITWLYYHFSETSLKGMTLVFETGQKKREDIPLLLIPLVMSGTWITHLFGGSAGREGVAVQIGAVLSHVLGRRFHLPKDSRVMLITGMAAGFGGLFQTPLTAVFFSMEVIVAGKIQYEALLPALIASYTAAYTSHTLGLEKLYVPLKDTLEISDAGMAVRLIVLGIIFGLTGRLFSFLLAKSKKFFGEKIKNPYFRIGVISIPLALILFLLYNGRYSGLGTNLISAAFSGGMIYSYDWILKLLLTILTLAIGYQGGEVTPLFSIGASLGIVLGGILSISPVHCAALGYAAVFAGATNTLLAPVLIGLEVFGANDMVPFLIVCIFAYLVNG

SEQ ID NO: 315 - protein, 333 aa, Ruminococcus lactaris ATCC 29176
AGLLIVWMYHRFSEESLKGMTLVLETGQKKRKSIPLALVPLVIVGTWLTHLFGGSAGREGVAVQIGAVISHEAGKKFRCPENDRIMLVAGMAAGFGGLFQTPLAAVFFAMEVIASGYMQYEALLPAMISAYTAAFTSHILGLEKFTAVIGEKLDLSETKVILSLIVLGILFGLVGRLFSGTLQWMKKRMGNAIKNPYIRIGAVAVFLAVLLFLFHGGRYSGLGTNLISAAFENGTIYGYDWILKLGFTVLTLAIGFQGGEVTPLFSIGASLGILAGNLLGISPVVCAALGYAAVFGSATNTLLAPVMIGLEVFGTENAIPLVVVCILAYLMNG

SEQ ID NO: 316 - protein, 331 aa, Bacteroides plebeius DSM 17135
AGLLIGLMYHYWAGTASRGNNYLIEEIRSPHDIIPFRMAPLVYIGTVLTHLFGGSAGREGTGVQMGGAIADQFSRLFRMRRRDHRLMVAIGISAGFASVFGTPLAGAVFGLEVIVVGRMRYEAILPSFLSAAVASMVCHAWGVEHTHYVVSEVPFPEASNLLWTIGAGILFGLAAMLFSRSIGFWSGMAKRISYPPFRPLIGGLVIAAAVWMMGTTKYIGLGVPTIVASFSEQQMWYDFLLKILFTTFTIGVGFKGGEVTPLFFVGATLGSALSAVVPLPMGLLAGIGFVAVFAGATNTPIACTLMGIELFGAEPGLYLGIACVVAYLFSG

SEQ ID NO: 317 - protein, 333 aa, Paenibacillus curdlanolyticus YK9
GGAFISWLYMRYGGAAAKGNNLILEQSYEAPEVRVPLRMGPLVLLGTWMTHLLGGSAGREGTAVQIGGSLAEQAGRWFKLTPHERRVVLLCGISSGFGSVFGTPLAGAIFGVELLAKGRLWRFAALLPCLLSSLAADQITKAWGTEHSHYWIGIVPALSLALLLKVIGASVLFGLAALIFSQLTHFLKAWFTRLIPYAPAKSFVGGVLVIALVYAAGTRQYIGLGLPLIAQSFHEAASPLAFAWKTLFTSLTLGAGYQGGEVTPLFAIGALLGSALAGLLHVSIPLLAAVGLISVFSGAANTPFACFVMGLELFGVDGAIYLFIGCIVAWICS

SEQ ID NO: 318 - protein, 332 aa, Sphingobacterium spiritivorum ATCC 33300
GGLSVGLLYYYWGKDVEAGNNLLIDTIHTPEQTIPFKMAPFVYLGTIITHLFGGSAGREGTALQMAGAIADQFSKRFRLNSEERKILIIAAVAAGFGSVFGTPLAGAIFGMEFFLIGRLRYNAIFPAFASAICADLITKLWNAHHTHYHIDIVPDLSFWHITLAIFAGILFGLCATVFSRTLKRTAQLFKSYISYPPLRPFTGGIIVAAAVWCIGTTAYIGLGIPGIEASFQQTAQPYDFALKMAFTILTLAAGFKGGEVTPLFFIGATLGSALSLFIPLPLGLLAGMGFVAVFSGATNTPLACSIMGIELFGAEAAVYIAIACILAYLFSG

SEQ ID NO: 319 - protein, 348 aa, Vibrio metschnikovii CIP 69.14
GLGLVFFYRQWGGISERGNNLIIDQIHQSNEKIPFRMSVFVLVATVVTHLFGGSAGREGTAVQIGGAVSAWFSRVFKLDESDQRSILVAGIAAGFGSVFGTPIAGAIFAVEVLSVGRIKYQALLPALIAAVLADVVCSAVGAHHTHYNIGFAQFNSLFEHPISIDFILTGKILIAGVIFGLVGLLFSELTSGLKAWFLRRLRNPYLIVFCGGLLVIAIVKLIGNYDYIGIGVYPIREGGVSITSAFEAGGAEWNSWILKLILTAITLAAGFKGGEVTPLFFIGATLGNFLAWVMGAPVELFAALGFLAVFAAAANTPLACIIMGVELFGADHLIYFALVCFIAYYASG

SEQ ID NO: 320 - protein, 333 aa, Terriglobus saanensis SP1PR4
AGFSVGLLYRHFGSKVEGGNALILEEIHDPQETISLRMTPLILLGTFLTHLFGGSAGREGTALQTGASLADQLTQPLGLDGSQRRLLLMLGTFLTHLFGGSAGREGTALQTGASLADQLTQPLGLDGSQRRLLLMDIVTRAWRVHHTIYRVDALAGFTPRTVLASVLAGALFGLMALIFSYGVHHLSSWSKKLVRFGPLRPAIGGVIIATAVFTMGTTRYIGLGVPVIVDAFHHVLPRADFAWKTIFTVVTLGLGFKGGEVTPLFFIGATMGNALSAVLPLPASLLAGMGFVAVFAGAAKTPIASTIMAFELFGPVPGCFAAIACVASYLCSG

SEQ ID NO: 321 - protein, 332 aa, Sphingobacterium spiritivorum ATCC 33861
GGLSVGLLYYYWGKDVEAGNNLLIDTIHKPEQTIPFKMAPFVYLGTIITHLFGGSAGREGTALQMAGAIADQFSKRFRLNAEERKILIIAAVAAGFGSVFGTPLAGAIFGMEFFLIGRLRYNAIFPAFASAICADLITKLWNAHHTHYHIDIVPELTFWHITLAVFAGILFGLCATVFSRTLKRTAQLFKSYISYPPLRPFIGGIIVAAAVWCIGTTAYIGLGIPGIEASFQQTAQPYDFALKMVFTILTLAAGFKGGEVTPLFFIGATLGSALSLFIPLPLGLLAGMGFVAVFSGATNTPLACSIMGIELFGAQAAVYIAIACILAYLFSG

SEQ ID NO: 322 - protein, 334 aa, Clostridium sp. M62/1
AGVLSVYLYRTFGEKCARGMGLAFEVGFGTEKEIPLRLIPLVTGSTWLTHLFGGSAGREGVAVQIGAAVSHGMFGRLPFKNSSRIFLVTGMAAGFAGLFRTPLAAVLFAAEVLWAGRLECRALVPALTASFTASTVSGALGLEKFAFPVESLNGGGLSLSTVFLLLGAGLIFGTVGGAFAWTLGRLKKGLGEAVKNPVVRIAVCSAGLSILLLLFYGGRYCGLGTNLIEGSLSGEDVKVFDWILKFFFTAVTIAAGFQGGEVTPLFSIGASLGAALSLILPLPLPLLAALGYAAVFGGATNTFLAPVFIGAEVFGCELLPCFFIVCAAARLFNG

SEQ ID NO: 323 - protein, 332 aa, Chryseobacterium gleum ATCC 35910
AGFLIGLLYYYFGKDVEAGNNLLIDTIHEPKGIIPFKMAPFVYLGTIATHFFGGSAGREGTALQMAGAIADQLTKPFKLDRNDRKVLIISAIAAGFGSVFGTPLAGAVFGLEVFLIGRIRYNAIFPAFASAVLADLVTNLWKVKHTHYHIDFVPKLEFLPILYSILAGIAFGICAAAFSKIIHWMGSFFKSKVKYPPLRPVAGGIIIALAVFAMGTTRYIGLGIPMIMESFEKQLPLYDFALKMIFTIVTLSAGFKGGEVTPLFFIGATLGSALSLFIPLPFGLLAGMGFVAVFAGATNTPLACMLMGIELFGAECGVYVAIACVVSYLLSG

SEQ ID NO: 324 - protein, 345 aa, Zymomonas mobilis subsp. mobilis ZM4
AGFITSWLYSRYGKLAAGGNNLILEEIHKPNAGVPLRMAPLIFISTVITHLFGGSAGREGTAVQLGGSIASGIGRIAGLDKKDIRLLLISGIAAGFGAVFGTPVTGAIFALEVPVIGRLEYRALIPALTAAILGDWVCRLWGMDHLRYSMASFSQMGHFQLNIILFFKVILASIAFGVIARLFSESLANSAQWFKKVIPSAPLISFTGGLIVIALVYITGTRDYLGIGTIAAQPNGLQLGSFFDAQQHHYWSWLLKFIFTVVTLSTGFKGGEVTPLFFIGAALGSTIAHIIGAPVDLFAGIGFIAVFGAAANTPLACIIMGVEMFGADNIVYFAAGCCTAYIFSG

SEQ ID NO: 325 - protein, 345 aa, Zymomonas mobilis subsp. mobilis NCIMB 11163
AGFITSWFYSRYGKLAAGGNNLILEEIHKPNAGVPLRMAPLIFISTVITHLFGGSAGREGTAVQLGGSIASGIGKIAGLDKKDIRLLLISGIAAGFGAVFGTPVTGAIFALEVPVIGRLEYRALIPALTAAILGDWVCRLWGMDHLRYSMASFSQMGHFQLNIILFFKVILASIAFGVIARLFSESLANSAQWFKKVIPSAPLISFTGGLIVIALVYITGTRDYLGIGTIAAQPNGLQLGSFFDPQQHHYWSWLLKFIFTVVTLSTGFKGGEVTPLFFIGAALGSTIAHIIGAPVDLFAGIGFIAVFGAAANTPLACIIMGVEMFGADNIVYFAAGCCTAYIFSG

SEQ ID NO: 326 - protein, 331 aa, Clostridium thermocellum JW20
AGVFITWCYNRFGSDSAKGMALLFEIHQDKRSSIPLRLIPFAVGSTWLTHLFGGSAGREGVATQIGGTLDSYIGNKIRVSGANKILMISGMAAGFSGLFHTPLAAVFFALEVLHCGVIEYSALLPSFVSAYTASCISEILGLQKSTYFLDCRIVPSFSFIMKIIVLGVLFGLTGMLFSILLKKLRALLTNYIKNNIIRIFVFGTIIGIISIICFQGRYSGPGTNLISACFSNDIMPWDFMLKILFTALTLAAGYYGGEVVPLFSIGASAGFVLANVLELPVELCVALGYVAVFGSATNTFFAPLFISTEIFGTEYLPVFAAVCAIAYMFNG

SEQ ID NO: 327 - protein, 345 aa, Zymomonas mobilis subsp. mobilis ATCC 10988
AGFITSWLYSRYGKLAAGGNNLILEEIHKPNVGVPLRMAPLIFISTVITHLFGGSAGREGTAVQLGGSIASGIGKIAGLDKKDIRLLLISGIAAGFGAVFGTPVTGAIFALEVPVIGRLEYRALIPALTAAILGDWVCRLWGMDHLRYSMASFSQMGHFQLNIILFFKVILASIAFGVIARLFSESLANSAQWFKKVIPSAPLISFTGGLIVIALVYITGTRDYLGIGTIAAQPNGLQLGSFFDPQQHHYWSWLLKFIFTVVTLSTGFKGGEVTPLFFVGAALGSTIAHIIGAPVDLFAGIGFIAVFGAAANTPLACIIMGVEMFGADNIVYFAAGCCTAYIFSG

SEQ ID NO: 328 - protein, 331 aa, Pedobacter heparinus DSM 2366
AGLVIGFVYHHKGKGVERGNNLIFDTVHNPAAIIPFKMVPLVLTGTVVTHLFGGSAGREGTALQMAAATADQLHKPFKLNAAERTILLIAGLSAGFASVFGTPLAGIVFGVEVLLLGKIPVKAILPAIVTAFIGAYVTELWGVGHTHYSIAFILPLTFRGIAYSVIAGLAFGLAAIAFVKLTEAFSHGFKKISYPPLRPFAGGVLVLLLFLLPGTYKFAGLGIPAILDSFNTASQGSDFALKILFTAITLGSGFKGGEVTPLFFIGATLGSALSVFLPLPVGLLAGMGFVAVFAGAAKTPLACCLMAMELFGLSCGIYVAIACTVSFFISG

SEQ ID NO: 329 - protein, 331 aa, Clostridium thermocellum DSM 2360
AGVFITWCYNRFGSDSAKGMALLFEIHQDKRSSIPLRLIPFAVGSTWLTHLFGGSAGREGVATQIGGTLGSYIGNKIRVSGANKILMISGMAAGFSGLFHTPLAAVFFALEVLHCGVIEYSALLPSFVSAYTASCISEILGLQKSTYFLDCRIVPSFSFIMKIIVLGVLFGLTGMLFSILLKKLRALLTNYIKNNIIRIFVFGTIIGIISIICFQGRYSGPGTNLISACFSNDIMPWDFMLKILFTALTLAAGYYGGEVVPLFSIGASAGFVLANVLELPVELCVALGYVAVFGSATNTFFAPLFISTEIFGTEYLPVFAAVCAIAYMFNG

SEQ ID NO: 330 - protein, 334 aa, Paenibacillus sp. JDR-2
GGALVSWLYMQYGKDAAKGNNLLLDRIYGGETAVPLRMAPLVLFGTIITHLFSGSAGREGTAVQMGGSLAEMIGKRFKLSGAERKIILLCGISSGFGSVFGTPAAGAIFALEVAALGAISLESILPIFLASYAGHYTTLAWGVRHLHYSMGTIPPPSVMLLIKVAAAAVLFGLSALLFVTLTHKLKAWFTKLLPNPMIKSFVGGLIIIALVYLIGSRNYLGLGLPLLQHSFEEAAAPLAFLWKTLFTSITLGSGFQGGEVTPLFVIGSTFGSALAKLLAVSVPLLAGIGLISIFSGATNTPLASFILGLELFGLQGYGWLYMLIGCAVAYLCSG

SEQ ID NO: 331 - protein, 331 aa, Clostridium thermocellum ATCC 27405
AGVFITWCYNRFGNDSAKGMALLFEIHQDKRSSIPLRLIPFAVGSTWLTHLFGGSAGREGVATQIGGTLGSYIGNKIRVSGANKILMISGMAAGFSGLFHTPLAAVFFALEVLHCGVIEYSALLPSFVSAYTASCISEILGLQKSTYFLDCRIVPSFSFIMKIIVLGVLFGLTGMLFSILLKKLRALLTNYIKNNIIRIFVFGTIIGIISIICFQGRYSGPGTNLISACFSNDIMPWDFMLKILFTALTLAAGYYGGEVVPLFSIGASAGFVLANVLGLPIELCVALGYAAVFGSATNTFFAPLFISTEIFGTEYLPVFAAVCAIAYMFNG

SEQ ID NO: 332 - protein, 332 aa, Turicibacter sanguinis PC909
GGAFVSYLYLKFGKDSAKGNNLIIERINEGVGEIPFRMAPLVFLGTAVTHLFGGSAGREGTGVQIGASICSKLSHFLHLNKEDATILIISGVSSGFGVVFGTPIAGTIFGLEVSTIGKMRYESIIPCLLSSYIGTYVSTLFNVSHSHYEMETLSSQNPFLFYKVMACSILFGLMSKLFAELTHYLKKIFSDKLKKSYVKSFVGGLIIIGLMLMIRNRMYLGLSLPLLKEAFESPVVGYAFLIKLLLTSITLATGFQGGEVTPLFVVGATFGNFLAPLFNLPLSFVAGLGMIGVFCGGTKTPLASFAMGLELFGGGNLKYLFITCVISYVFAG

SEQ ID NO: 333 - protein, 341 aa, Lentisphaera araneosa HTCC2155
GGLCIGLIYHYLGQNVVKGNNQLLDEIIQPKKIIPLRMAPLVALGTIATHLFGGSAGREGTGVQMGGAIADQFSQIFKLDKDERRILIIAGVAAGFSAVFGTPLAGAVFALEVYIIGRVQYQAILPAFLSAIIADQVCVQWKYPTVVTHTHYLHPEALALSPSTLFYTFLVAILFGWTAMLFSKANHFWSDLFSKKISYPPLRPFIGGIVLALAFWALGQTSVDFTKYVGLGVPVIEESFTQRMMPYDFALKLLFTSFTLGAGFKGGEVTPLFFIGATLGSALSFIIPLPLALLAAIGFVGVFSGATNTPIACTLMGIELFGAQIGIYLGLSCVVAYIFSG

SEQ ID NO: 334 - protein, 330 aa, Granulicatella elegans ATCC 700633
GFLFHTVYLKYGKNAVEGMNIVFRIGQGEDNRISKWLIPFMMIGTWLAHLFGASVGREGVAVQLGATVANQFQQWFSSKRNRQILLMIGMASGFAGLFGTPLAATFFAIEVMIVGQLQIDALFYALLSSFISMNVAQRLGLEKFMVGILVDIQFDETLLKMVVLGIAFGLTGRLFSVSLAYLKKYWSNKIPSPTLRIFLLGIGVSILIAAFGSGRYAGLGTNLIHASFYSETIFVQDWLFKLGLTVFSLSAGFLGGEVTPLFSIGSSLGIVMSSWLGISPMVAAALGYGAVFGSATNTWLAPIFIIGEVFGYSMMPYAAIVCIVAFVVNG

SEQ ID NO: 335 - protein, 332 aa, Herpetosiphon aurantiacus DSM 785
GGLVAWLYQRFGTSVAAGNNLIIEQLHNPDSAGIPLRMAPLVLLGTLLTHLGGGSAGREGTAVQMGASLAARIGRWWRLPQAEWRLVVMMGISAGFSSVFGTPIAGTIFAMEVLAFGVLRYEALLPCLVAALVGDGVVRWLNVAHSHYHVGSVPDLSMIWAILVGAGICFGLASSAFAIWTELVQTWSRRWLPNPILRAVAGGGLIVSISFLLNTRDYNGLSLPLLAQAFEPRGVVFWAFALKLLLTGLTLGVGFKGGEVTPLFVIGATLGSALAQLFGVPTDLLAALGFIAVFAGAANTPIACVLMGVELFGSALLGPLMLTTCIAYAISG

SEQ ID NO: 336 - protein, 333 aa, Myxococcus xanthus DK 1622
AGLVLGAVYGKWGRPIRGGNNLVLDTVHASDAQVPVRMAPMVLVGTVLTHLFGGSAGREGTAVQMGGSLADLVARRFRVGPDTRRELLAAGIAGGFGSVFGTPVAGAVFGLEVVVVGRMGYEALLPALVASVVGDMVTRGLGIHHTPYPAPGALPLTVAVLAKWLVFAVAVAVVAVVFVELMHRLKKLLEQRVQVLPLRMALGGLAVLLLWLLAGTDDYLGLGVPGIQRAFEDPALPVSAFAWKLAFTVVTLAAGFLGGEVTPLFFIGASLGNVLARLLGLPLDLGAAVGMAALFAAAANTPLALSIMAVELLGANVLPHVAIVATVAYLLTG

SEQ ID NO: 337 - protein, 333 aa, Stigmatella aurantiaca DW4/3-1
AGLAVGALYARWGSSIRGGNNLVLDTVHEGDRQIPLRMAPLVLLGTVLTHLFGGSAGREGTAVQMGGSLADAIAHRFRVSADTRRELLAAGIAGGFGSVFGTPIAGAVFGLEVLVVGRLGYEALLPALVAAVVGDLTTRGLGIVHTAYPAPSVLPLTGGVLAKWCVFAVAVAAVAVVFVEGTHRLKKLLEGRIPALPLRMAVGGLAVVGLWKLVGTDMYLGLGVPTLVRAFVDPALPESAFAWKLLFTAVTLGAGFLGGEVTPLFFIGAALGNVLARVLGLPLDLGAAVGMAALFAAAANTPLALTIMAVELVGASVLPHVAIVAALAYLLTG

SEQ ID NO: 338 - protein, 333 aa, Algoriphagus sp. PR1
GGFLIGWTYYKYAESSVKGNNLLLEELYQSKSPIPLRMTPLVLFGTIGTHLFGGSAGREGTAVQMGGSLADQLTKWFKLSHEERRLVIIAGVAAGFASVFGTPLAGAIFALEWMLSRKFRWRSLYPAFFTGYIAHLVCANLWGIGHTHYSIPEVPGFTLINFLWIIPAGIAFGFSGRLFAQTTHFFTHQFSKWVSYPPLRPVIGGLVIAIIVWFSDSTTYIGLGVPRIVEAFEQPLPWYDWLVKTGMTGFTLGAGFKGGEVTPLFFTGATLGNALSTWIPLPLALLAGMGFVGVFSGATNTPMACTVMGMELFGYESGLYLAIACFIAYVFSG

SEQ ID NO: 339 - protein, 328 aa, Stigmatella aurantiaca DW4/3-1
GALYARWGSSIRGGNNLVLDTVHEGDRQIPLRMAPLVLLGTVLTHLFGGSAGREGTAVQMGGSLADAIAHRFRVSADTRRELLAAGIAGGFGSVFGTPIAGAVFGLEVLVVGRLGYEALLPALVAAVVGDLTTRGLGIVHTAYPAPSVLPLTGGVLAKWCVFAVAVAAVAVVFVEGTHRLKKLLEGRIPALPLRMAVGGLAVVGLWKLVGTDMYLGLGVPTLVRAFVDPALPESAFAWKLLFTAVTLGAGFLGGEVTPLFFIGAALGNVLARVLGLPLDLGAAVGMAALFAAAANTPLALTIMAVELVGASVLPHVAIVAALAYLLTG

SEQ ID NO: 340 - protein, 341 aa, Dorea longicatena DSM 13814
GGVFIWFIYHQFGKSVANGMKMVFHVGLGKNTKLPIRMVPLSVIGTWTTHLFGGSAGREGVAVQIGAAVSNNIGRLVDKTIDIENSRKMFLITGMAAGFSGLFCTPLAAIFFALEVLVAGKLEYHALIPATVASISAAFTSRALGLRKFHINILETLNYHPSTYNAVLLLKLAAMGLVFGIVGSLFALILRYLRLKFAFRFSSPVKKVLIMGSVVAILMMIFHQGRYSGTGSNLVALCFDGITDDIYAYDWILKMALTILTLSSGFIGGEVAPLFSIGSCLGYVLGPVFGFDPMFGAALGFASVFCSGSNTLLAAILVGVESFGYNMLPFFSVVCFVSFIF

SEQ ID NO: 341 - protein, 330 aa, Leptospira biflexa serovar Patoc strain 'Patoc 1 (Ames)'
GFFIGWVYHQFGSKASKGNNLLLEEIHSPSSVIPIRMAPLVLFGTLLTHFFGGSAGREGTAVQMGGSIAHQIVRFYRLSLKEQQTLIILGMSAGFSAVFGTPIAAAIFSIEVIQIGAYRWKLFLPSLLIAWISHEVCLYWKVSHSVFPNVTFEFESILILVLFLLAIASGFVAKLFTWLLHSISKYSQTWIVYPPFRPFVGGIILVVFFLSGVHLDYFGLGVKTIQNAFTGFLPYESFFWKLILTVITIGFGFKGGEVTPLFFIGASLGNLFAILDPVHLTLFVSVGFISVFSGATNTPLACAVMGMELFGFQSGVVFFIATQIAYIMSG

SEQ ID NO: 342 - protein, 330 aa, Leptospira biflexa serovar Patoc strain 'Patoc 1 (Paris)'; identical to SEQ ID NO: 341

SEQ ID NO: 343 - protein, 332 aa, Flavobacterium johnsoniae UW101
GGLLVGLSYYYWGESVVKGNNLLLEEYEKPKKVIPFKMAPLVLLGTLLTHLFGGSAGREGTAVQMGGAIADQFTKIFNLDNAERRILIILGISAGFASVFGTPLAGAVFALEVLYFSKINFKSALLSFVVAYAAYFTVEFWKIKHTHYSIPVVPELNFDTIFYTILLGLLSGFAALLFSRSTHFWGSLFSKNIKYPPLRPVIGGVVLAVAIAGLGFTKFSGLGVPVIVDSFSNPSEWYDFLLKILFTGFTLGAGFKGGEVTPLFFVGATLGSALSIFIPMPIALLAGVGFVSVFSGATHTPIACTIMGMELFGIQPGIFIALGCTIAYFSSG

SEQ ID NO: 344 - protein, 359 aa, Pirellula staleyi DSM 6068
AGVLVALAYQRLCPQAEAGNNLLLEEIHEPAAGVPLWMAPLVLLGTLATHVTGGSAGREGTAVQMGGSLAHSVGQWLGIERSEQRTFLMAGMAAGFGAVFGTPVAGAIFAIEVLTHGQLSYRGFLTCLLASIVGDTTTTLCGIGHTEYKIAPWMSAAAGSHLGPLDLVLLLKIVIAAVAFGLMARLFAELTHRTSALLKRYVPWSLARPAIGAAVVLLLTAIVASRDYLGLGVMPDPHDPSLMTIAGCFEEGGAGPMSWAWKTVFTAVTVGSGFKGGEVTPLFFIGAAGGNAMGTLLSAPLGLLAAVGFVSLFAAATKTPLASTLMGIELFVHGGDDLVGSGLVIYLAVGCYVASWVSG

SEQ ID NO: 345 - protein, 330 aa, Ethanoligenens harbinense YUAN-3
GVFTVFLYTRFGKNAQRGNNLIIDSVNENEQVPLRMGIFTFICTVLTQLVGGSVGREGTAVQVGGTIANVLGRAFHLHHPYHRILVMAGISAGFGSVFGMPLAGAVFGMEMCFVGHLGYEALLPCFVASFTADSVTRALGITHETYAITSVPAVGWYSLLVVVIAAMIFGVAGRLFAVAIRALKLFYARRVSHPIPRVLLGSAVLLVAMLALRAVPYAGLSTWMIGAGFAGKAQWYDGPLKLLMTVLSLGAGFQGGEVTPLFDIGAGLGGWLGLVARLSPSLLAALGMISVFGCAANTPLTTLIMGFELFGNQSLPFVVIAVFVSYYVSG

SEQ ID NO: 346 - protein, 347 aa, Planctomyces limnophilus DSM 3776
GAISAWLYLFFGREAGQGNNLVIAEIQHPMKGLPWFMAPLIVLATILTHLGGGSAGREGTAVQMGAGLAGIWARWTKPWLGEDYREILLMGVAAGFGGVFGTPVAGAIFAAEVLSVGRLPTSAILPCLLASCGADFVCTTVGGTHLHYPVDWAELNPSGWLHRLGIVGLIILLGAVAGLVAKGFSEGLHLAGRWYAKLLPDPIRRIAVGSLVVVFVAEFVVGRDYLGLGTTNLNPHAVTIGSCFRAGGAHDWSWLCKLLLTILTLACGLKGGEVTPLFFIGAALGNVLAVKTGLLPVDVAAALGFVAVFSAATNAPLASSVLAIELFGPDRIEYVFAACFSAWLVAG

SEQ ID NO: 347 - protein, 320 aa, Gemella haemolysans ATCC 10379
YLHTSAIGMKYFIEAATDKKEKVTWEFPFLLTLNTLLAHSFGVSVGREGVAVQLGGAIGGNIAPDDFSTEKKQFFVKLGMICGFAGLFQTPLAAVVFILEVVSDKFNFTINKIFEYVTYIAAAYISAYISHKLGLEKFFVAIDVSEININLEFISKLFLVGVVFVFVGILFVLLQRKTKGLVALNTNIIWILLVVFILVNIVFDYRYASLGTNLIDFSFTDFEQIQVYDFMLKIILTAICTGIGFSGGEVTPLFAIGATCGVILGIWLGLPILVTAALGYCLVFSAATKTYITPIFLALEVFGYKLMLFVVIPAILIYLI

SEQ ID NO: 348 - RNA, 41 nt, Pseudomonas syringae
  MISC (1)..(1): nucleotide is present -90%
  misc_feature (1)..(1): n is a, c, g, or u
  MISC (4)..(4): nucleotide is present - 97%
  misc_feature (5)..(5): n is a, c, g, or u
  MISC (10)..(10): nucleotide is present - 97%
  misc_feature (11)..(11): n is a, c, g, or u
  MISC (15)..(15): nucleotide is present - 97%
  misc_feature (16)..(16): n is a, c, g, or u
  MISC (18)..(19): NR-vriable-YN - 31% where n is present 97%; R = A/C and Y = C/U
  misc_feature (19)..(19): n is a, c, g, or u
  MISC (35)..(35): Nucleotide present - 97%
  misc_feature (37)..(37): n is a, c, g, or u
ngggnraugrnguyynccnaaccgcyrgcugaugacncury

SEQ ID NO: 349 - RNA, 80 nt, Pseudomonas syringae
gcaucggcgcauuggagauggcauuccuccauuaacaaaccgcugcgcccguagcagcugaugaugccuacagaaaccug

SEQ ID NO: 350 - RNA, 65 nt, Thermotoga petrophila
ggauaacccaacgggcgaugaggccccccccaaacugcccugaagagggcugauggccucuacug

SEQ ID NO: 351 - RNA, 76 nt, Thermoplasma volcanium
ggacuaacacccguggaauggcguuuccacucguacaaaccgccagcuccagcugacugaugacgccugauugaaa

SEQ ID NO: 352 - RNA, 80 nt, Artificial Sequence
  Synthetic 78 Psy RNA construct
ggaucggcgcauuggagauggcauuccuccauuaacaaaccgcugcgcccguagcagcugaugaugccuacagaaaccug

SEQ ID NO: 353 - RNA, 70 nt, Pseudomonas syringae
aucggcgcauuggagauggcauuccuccauuaacaaaccgcugcgcccguagcagcugaugaugccuaca

We claim:

1. A fluoride aptamer nucleic acid molecule comprising
   (a) a fluoride aptamer,
   wherein the fluoride aptamer comprises a nucleic acid structure that selectively binds a fluoride anion or fluoride with a counterion, and
   (b) (i) one or more nucleic acid sequences that are heterologous to the fluoride aptamer and linked to the nucleic acid molecule, (ii) a heterologous component that is conjugated to the nucleic acid molecule, or (iii) both.

2. The fluoride aptamer nucleic acid molecule of claim 1, wherein the fluoride aptamer is derived from a naturally-occurring fluoride-responsive riboswitch.

3. The fluoride aptamer nucleic acid molecule of claim 1 further comprising a sequestration tag, wherein the sequestration tag can be used to separate the fluoride aptamer nucleic acid molecule from a mixture.

4. The fluoride aptamer nucleic acid molecule of claim 1 further comprising an expression platform domain operably linked to the fluoride aptamer, wherein the fluoride aptamer and the expression platform domain constitute a fluoride-responsive riboswitch, wherein the fluoride aptamer constitutes the aptamer domain of the fluoride-responsive riboswitch.

5. The fluoride aptamer nucleic acid molecule of claim 4, wherein the expression platform domain is heterologous to the fluoride aptamer.

6. The fluoride aptamer nucleic acid molecule of claim 1, wherein the fluoride aptamer is operably linked to a signal-generating component, wherein the signal-generating component generates a signal when the fluoride aptamer is bound by fluoride.

7. The fluoride aptamer nucleic acid molecule of claim 6, wherein the fluoride aptamer and the signal-generating component are heterologous.

8. A fluoride-regulated expression construct comprising a nucleic acid molecule encoding the fluoride aptamer nucleic acid molecule of claim 4, wherein the fluoride-responsive riboswitch is operably linked to a coding region, wherein expression of the coding region is regulated by the riboswitch.

9. The fluoride-regulated expression construct of claim 8, wherein the riboswitch and coding region are heterologous.

10. The construct of claim 8, wherein expression of the coding region induces or causes death of the cell in which it is expressed.

11. A cell comprising the fluoride-regulated expression construct of claim 8, wherein the cell is a recombinant or isolated cell.

12. The cell of claim 11, wherein expression of the coding region is regulated by fluoride.

13. The cell of claim 11, wherein the coding region encodes an expression product, wherein production of the expression product by the cell is regulated by fluoride.

14. A cell comprising the fluoride aptamer nucleic acid molecule of claim 1, wherein the cell is a recombinant or isolated cell.

15. A method of sensing fluoride, the method comprising bringing into contact a sample or an environment to be assessed and the cell of claim 11, wherein expression of the coding region produces a signal, wherein the signal indicates the presence of fluoride in the sample or environment.

16. A method of sensing fluoride, the method comprising bringing into contact a sample or an environment to be assessed and the cell of claim 14, wherein the fluoride aptamer is operably linked to a signal-generating component, wherein the signal-generating component generates a signal when the fluoride aptamer is bound by fluoride, wherein the signal indicates the presence of fluoride in the sample or environment.

17. A method of sensing fluoride, the method comprising bringing into contact a sample or an environment to be assessed and the fluoride aptamer nucleic acid molecule of claim 6, wherein the signal indicates the presence of fluoride in the sample or environment.

18. A method of separating fluoride from a mixture, the method comprising bringing into contact the mixture and the fluoride aptamer nucleic acid molecule of claim 3, and separating the fluoride aptamer nucleic acid molecule from the mixture via the sequestration tag, thereby separating fluoride from the mixture.

19. A method of separating fluoride from a mixture, the method comprising bringing into contact the mixture and a solid support, wherein the solid support comprises the fluoride aptamer nucleic acid molecule of claim 1, and separating the mixture from the solid support, thereby separating fluoride from the mixture.

20. A method of separating fluoride from a mixture, the method comprising bringing into contact the mixture and the cell of claim 14, wherein the fluoride aptamer nucleic acid molecule is sequestered in an inclusion body, thereby separating fluoride from the mixture.

21. The method of claim 20, wherein the fluoride aptamer nucleic acid molecule is sequestered in an inclusion body via the sequestration tag.

22. The method of claim 20 further comprising separating the cell from the mixture.

23. The fluoride aptamer nucleic acid molecule of claim 1, wherein the fluoride aptamer comprises a crcB motif, or an $eriC^F$ motif, or both a crcB motif and an $eriC^F$ motif.

24. The fluoride aptamer nucleic acid molecule of claim 1, wherein the fluoride aptamer is selected from the group consisting of SEQ ID NO:348, SEQ ID NO:349, SEQ ID NO:350, SEQ ID NO:351, SEQ ID NO:352, and SEQ ID NO:353.

25. The fluoride aptamer nucleic acid molecule of claim 1, wherein the fluoride aptamer is SEQ ID NO:349.

26. The fluoride aptamer nucleic acid molecule of claim 1, wherein the fluoride aptamer is SEQ ID NO:348.

27. The fluoride aptamer nucleic acid molecule of claim 1, wherein the fluoride aptamer binds fluoride anions with a dissociation constant of between 50 μM and 60 μM, inclusive.

28. The fluoride aptamer nucleic acid molecule of claim 1, wherein the fluoride aptamer does not bind to chloride, bromide, and iodine anions.

29. The fluoride aptamer nucleic acid molecule of claim 1, wherein the heterologous nucleic acid sequence comprises a heterologous open reading frame.

30. The fluoride aptamer nucleic acid molecule of claim 29, wherein the heterologous open reading frame is operable linked to the fluoride aptamer.

* * * * *